US007642079B2

(12) United States Patent
Cayouette et al.

(10) Patent No.: US 7,642,079 B2
(45) Date of Patent: Jan. 5, 2010

(54) PROTEASES, NUCLEIC ACIDS ENCODING THEM AND METHODS FOR MAKING AND USING THEM

(76) Inventors: Michelle Cayouette, 3812 Park Blvd., #505, San Diego, CA (US) 92103; Connie Jo Hansen, 3645 Gayle St., San Diego, CA (US) 92115; Amy McClure, 4026 Donna Ave., San Diego, CA (US) 92115; May Sun, 15884 Camino Cordorniz, San Diego, CA (US) 92127; Svetlana Gramatikova, 5709 Erlanger, San Diego, CA (US) 92122; Mark Dycaico, 14208 LA Trucha St., San Diego, CA (US) 92129; Nelson R. Barton, 10928 Sunset Ridge Dr., San Diego, CA (US) 92131; Justin T. Stege, 11355 Dennig Pl., San Diego, CA (US) 92126; Nahla M. Aboushadi, 442 Lexington Cir., Oceanside, CA (US) 92057

( * ) Notice: Subject to any disclaimer, the term of this patent is extended or adjusted under 35 U.S.C. 154(b) by 94 days.

(21) Appl. No.: 10/530,643

(22) PCT Filed: Oct. 10, 2003

(86) PCT No.: PCT/US03/32819

§ 371 (c)(1),
(2), (4) Date: Apr. 7, 2006

(87) PCT Pub. No.: WO2004/033668

PCT Pub. Date: Apr. 22, 2004

(65) Prior Publication Data

US 2006/0259995 A1   Nov. 16, 2006

Related U.S. Application Data

(60) Provisional application No. 60/471,423, filed on May 16, 2003, provisional application No. 60/418,467, filed on Oct. 10, 2002.

(51) Int. Cl.
*C12N 9/48* (2006.01)
(52) U.S. Cl. .................................... 435/212
(58) Field of Classification Search ................ None
See application file for complete search history.

(56) References Cited

U.S. PATENT DOCUMENTS

| 4,261,868 | A | | 4/1981 | Hora et al. |
| 4,404,128 | A | | 9/1983 | Anderson |
| 4,677,069 | A | * | 6/1987 | Chen et al. ............... 435/226 |
| 4,788,066 | A | | 11/1988 | Witt |
| 5,021,246 | A | | 6/1991 | Sieben et al. |
| 5,106,621 | A | * | 4/1992 | Rowan et al. ............ 424/94.65 |
| 5,204,015 | A | | 4/1993 | Caldwell et al. |
| 5,405,624 | A | | 4/1995 | Doncheck et al. |
| 5,536,650 | A | | 7/1996 | Versteegh |
| 5,582,681 | A | | 12/1996 | Back et al. |
| 5,679,630 | A | * | 10/1997 | Baeck et al. ............... 510/305 |
| 5,696,068 | A | * | 12/1997 | Outtrup et al. ............ 510/392 |
| 5,709,796 | A | | 1/1998 | Fuqua et al. |
| 5,762,991 | A | | 6/1998 | Dziondziak et al. |
| 5,856,164 | A | | 1/1999 | Outtrup et al. |
| 5,980,581 | A | | 11/1999 | Patterson, Jr. et al. |
| 6,017,751 | A | | 1/2000 | von der Osten et al. |
| 6,021,536 | A | | 2/2000 | Wasinger et al. |
| 6,024,766 | A | | 2/2000 | Wasinger |
| 6,066,233 | A | | 5/2000 | Olsen et al. |
| 6,077,316 | A | | 6/2000 | Lund et al. |
| 6,197,070 | B1 | | 3/2001 | Horner et al. |
| 6,204,232 | B1 | | 3/2001 | Borchert et al. |
| 6,241,849 | B1 | | 6/2001 | Franks |
| 6,261,828 | B1 | | 7/2001 | Lund |

(Continued)

FOREIGN PATENT DOCUMENTS

| EP | 0 494 149 | 7/1992 |
| WO | WO-97/01629 | 1/1997 |

OTHER PUBLICATIONS

In house BLAST search results; Alignment of SEQ ID No. 4 with gbAAC60459.1 disclosed Nov. 20, 1996. From Tsujibo et al, Cloning and sequence of an alkaline serine protease-encoding gene from the marine bacterium Alteromonas sp. strain O-7. Gene. Dec. 22, 1993;136(1-2):247-51.*
Galye et al, Identification of regions in interleukin-1 alpha important for activity. J Biol Chem. Oct. 15, 1993;268(29):22105-11.*
Whisstock et al, Prediction of protein function from protein sequence and structure. Q Rev Biophys. Aug. 2003;36(3):307-40. Review.*
Matsuzawa et al, Purification and characterization of aqualysin I (a thermophilic alkaline serine protease) produced by *Thermus aquaticus* YT-1. Eur J Biochem. Feb. 1, 1988;171(3):441-7.*
USPTO in house alignment UniProt Acc. No. P08594 with SEQ ID No. 42. Performed Jul. 1, 2008.*

(Continued)

*Primary Examiner*—Sheridan Swope

(57) ABSTRACT

The invention is directed to polypeptides having protease activity, polynucleotides encoding the polypeptides, and methods for making and using these polynucleotides and polypeptides. The polypeptides of the invention can be used in a variety of diagnostic, therapeutic, and industrial contexts. The polypeptides of the invention can be used as, e.g., an additive for a detergent, for processing foods and for chemical synthesis utilizing a reverse reaction. Additionally, the polypeptides of the invention can be used in food processing, brewing, bath additives, alcohol production, peptide synthesis, enantioselectivity, hide preparation in the leather industry, waste management and animal degradation, silver recovery in the photographic industry, medical treatment, silk degumming, biofilm degradation, biomass conversion to ethanol diodefense, antimicrobial agents and disinfectants, personal care and cosmetics, biotech reagents, in increasing starch yield from corn wet milling and pharmaceuticals such as digestive aids and anti-inflammatory (anti-phlogistic) agents.

11 Claims, 8 Drawing Sheets

U.S. PATENT DOCUMENTS

| | | | |
|---|---|---|---|
| 6,264,925 | B1 | 7/2001 | Fuglsang et al. |
| 6,297,038 | B1 | 10/2001 | Bisgård-Frantzen et al. |
| 6,309,871 | B1 | 10/2001 | Outtrup et al. |
| 6,326,341 | B1 | 12/2001 | Chatterjee et al. |
| 6,329,333 | B1 | 12/2001 | Merz et al. |
| 6,333,301 | B1 | 12/2001 | Kamiya |
| 6,365,561 | B1 | 4/2002 | Vinson et al. |
| 6,380,147 | B1 | 4/2002 | Speckmann et al. |
| 6,399,561 | B1 | 6/2002 | Schneider et al. |
| 6,413,928 | B1 | 7/2002 | Painter et al. |
| 2002/0142438 | A1 | 10/2002 | Andersen et al. |

OTHER PUBLICATIONS

Arisawa et al., Appl. Environ. Microbiol. (2002) 68(6):2716-2725.
Boschwitz et al., J. Gen. Microbiol. (1991) 137(5):1145-1153.
Crabb, ACS Symposium Series (1991) 460:82-94.
Gupta, Appl. Microbiol. Biotechnol. (2002) 59:15-32.
Haard and Simpson, in Fisheries Processing: Biotechnological Applications, Martin (ed.), Chapman and Hall, London (1994) pp. 132-154.
Haring et al., J. Org. Chem. (1999) 64:832-835.
Hoondal, Applied Microbiology and Biotechnology (2002) 59:409-418.
Johnston and Singh, Cereal Chem. (2001) 78(4):405-411.
Kida et al., Journal of Fermentation and Bioengineering (1995) 80:478-484.
Li et al., J. Biochem. (1998) 124:332-339.
Loeffler et al., Science (2001) 294:2170-2172.
Pommer, Petfood Industry (May 10-11, 2002).
Rawlings and Barett, Biochem. J. (1993) 290:205-218.
Yamamura, Biochem. Biophys. Res. Com. (2002) 294:1138-1143.

* cited by examiner

PROTEASES, NUCLEIC ACIDS ENCODING THEM AND METHODS FOR MAKING AND USING THEM

CROSS-REFERENCE TO RELATED APPLICATIONS

This application is a national phase application claiming benefit of priority under 35 U.S.C. 371 to Patent Convention Treaty (PCT) International Application Serial No: PCT/US03/32819, filed Oct. 10, 2003, which claims benefit of priority to U.S. Provisional Patent Applications Ser. No. ("USSN") 60/471,423 filed May 16, 2003, and U.S. Ser. No. 60/418,467 filed Oct. 10, 2002. The aforementioned applications are explicitly incorporated herein by reference in their entirety and for all purposes.

TECHNICAL FIELD

This invention relates to molecular and cellular biology and biochemistry. In particular, the invention relates to protease enzymes, polynucleotides encoding the enzymes, methods of making and using these polynucleotides and polypeptides. The polypeptides of the invention can be used in a variety of diagnostic, therapeutic, and industrial contexts. The polypeptides of the invention can be used as, e.g., an additive for a detergent, for processing foods and for chemical synthesis utilizing a reverse reaction. Additionally, the polypeptides of the invention can be used in food processing, brewing, bath additives, alcohol production, peptide synthesis, enantioselectivity, hide preparation in the leather industry, waste management and animal degradation, silver recovery in the photographic industry, medical treatment, silk degumming, biofilm degradation, biomass conversion to ethanol, biodefense, antimicrobial agents and disinfectants, personal care and cosmetics, biotech reagents, in increasing starch yield from corn wet milling and pharmaceuticals such as digestive aids and anti-inflammatory (anti-phlogistic) agents.

SUBMISSION ON COMPACT DISC

The content of the following submission on compact discs is incorporated herein by reference in its entirety: A compact disc copy of the sequence listing (COPY 1) (file name: 564462004100, date recorded: Jan. 10, 2006, size: 909,312 bytes); a duplicate compact disc copy of the sequence listing (COPY 2) (file name: 564462004100, date recorded: Jan. 10, 2006, size: 909,312 bytes); and a computer readable form copy of the sequence listing (CRF COPY) (file name: 564462004100, date recorded: Jan. 10, 2006, size: 909,312 bytes).

BACKGROUND

Enzymes are used within a wide range of applications in industry, research, and medicine. Through the use of enzymes, industrial processes can be carried out at reduced temperatures and pressures and with less dependence on the use of corrosive or toxic substances. The use of enzymes can thus reduce production costs, energy consumption, and pollution as compared to non-enzymatic products and processes. An important group of enzymes is the proteases. Proteases are carbonyl hydrolases which generally act to cleave peptide bonds of proteins or peptides. Proteolytic enzymes are ubiquitous in occurrence, found in all living organisms, and are essential for cell growth and differentiation. The extracellular proteases are of commercial value and find multiple applications in various industrial sectors. Industrial applications of proteases include food processing, brewing, alcohol production, peptide synthesis, enantioselectivity, hide preparation in the leather industry, waste management and animal degradation, silver recovery in the photographic industry, medical treatment, silk degumming, biofilm degradation, biomass conversion to ethanol, biodefense, antimicrobial agents and disinfectants, personal care and cosmetics, biotech reagents and in increasing starch yield from corn wet milling. Additionally, proteases are important components of laundry detergents and other products. Within biological research, proteases are used in purification processes to degrade unwanted proteins. It is often desirable to employ proteases of low specificity or mixtures of more specific proteases to obtain the necessary degree of degradation.

Proteases are classified according to their catalytic mechanisms. The International Union of Biochemistry and Molecular Biology (IUBMB) recognizes four mechanistic classes: (1) the serine proteases; (2) the cysteine proteases; (3) the aspartic proteases; and (4) the metalloproteases. In addition, the IUBMB recognizes a class of endopeptidases (oligopeptidases) of unknown catalytic mechanism. Classification by catalytic types has been suggested to be extended by a classification by families based on the evolutionary relationships of proteases (see, e.g., Rawlings, N. D. and Barett, A. J., (1993), Biochem. J., 290, 205-218). The serine proteases have alkaline pH optima, the metalloproteases are optimally active around neutrality, and the cysteine and aspartic enzymes have acidic pH optima (Biotechnology Handbooks. *Bacillus*. vol. 2. edited by Harwood, 1989 Plenum Press, New York). Aspartic proteases are rare for bacteria and to date none have been reported for bacterial pathogens. Metalloproteases, on the other hand, seem to be a common feature in most bacterial pathogens. Thus, basic two classes of bacterial proteases are serine proteases and metalloproteases.

Serine proteases are characterized by a catalytic triad of serine, histidine, and aspartic acid residues. They include a diverse class of enzymes having a wide range of specificities and biological functions. The serine proteases class comprises two distinct families: the chymotrypsin family, which includes the mammalian enzymes such as chymotrypsin, trypsin, elastase, or kallikrein, and the subtilisin family, which include the bacterial enzymes such as subtilisin. The general 3D structure is different in two families, but they have the same active site geometry and catalysis proceeds via the same mechanism. Serine proteases are used for a variety of industrial purposes. For example, the serine protease subtilisin is used in laundry detergents to aid in the removal of proteinaceous stains (e.g., Crabb, ACS Symposium Series 460:82-94, 1991). In the food processing industry, serine proteases are used to produce protein-rich concentrates from fish and livestock, and in the preparation of dairy products (Kida et al., Journal of Fermentation and Bioengineering 80:478-484, 1995; Haard and Simpson, in Martin, A. M., ed., Fisheries Processing: Biotechnological Applications, Chapman and Hall, London, 1994, 132-154; Bos et al., European Patent Office Publication 494 149 A1).

Metalloproteases (MPs) and serine proteases form the most diverse of the catalytic types of proteases. They can be found in bacteria, fungi, as well as in higher organisms. They differ widely in their sequences and structures, but the great majority of enzymes contain a zinc atom which is catalytically active. In some cases, zinc may be replaced by another metal such as cobalt or nickel without loss of activity. The catalytic mechanism leads to the formation of a non-covalent tetrahedral intermediate after the attack of a zinc-bound water molecule on the carbonyl group of the scissile bond. This intermediate is further decomposed by transfer of the glutamic acid portion to the leaving group.

In general, enzymes, including proteases, are active over a narrow range of environmental conditions (temperature, pH, etc.), and many are highly specific for particular substrates. The narrow range of activity for a given enzyme limits its applicability and creates a need for a selection of enzymes that (a) have similar activities but are active under different conditions or (b) have different substrates. For instance, an enzyme capable of catalyzing a reaction at 50° C. may be so inefficient at 35° C., that its use at the lower temperature will not be feasible. For this reason, laundry detergents generally contain a selection of proteolytic enzymes, allowing the detergent to be used over a broad range of wash temperature and pH. In view of the specificity of proteolytic enzymes and the growing use of proteases in industry, research, and medicine, there is an ongoing need in the art for new enzymes and new enzyme inhibitors.

SUMMARY

The invention provides isolated or recombinant nucleic acids comprising a nucleic acid sequence having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary nucleic acid of the invention, e.g., SEQ ID NO:1; SEQ ID NO:3; SEQ ID NO:5; SEQ ID NO:7; SEQ ID NO:9; SEQ ID NO:11; SEQ ID NO:13; SEQ ID NO:15; SEQ ID NO:17; SEQ ID NO:19; SEQ ID NO:21; SEQ ID NO:23; SEQ ID NO:25; SEQ ID NO:27; SEQ ID NO:29; SEQ ID NO:31; SEQ ID NO:33; SEQ ID NO:35; SEQ ID NO:37; SEQ ID NO:39; SEQ ID NO:41; SEQ ID NO:43; SEQ ID NO:45; SEQ ID NO:47; SEQ ID NO:49; SEQ ID NO:51; SEQ ID NO:53; SEQ ID NO:55; SEQ ID NO:57; SEQ ID NO:59; SEQ ID NO:61; SEQ ID NO:63; SEQ ID NO:65; SEQ ID NO:67; SEQ ID NO:69; SEQ ID NO:71; SEQ ID NO:73; SEQ ID NO:75; SEQ ID NO:77; SEQ ID NO:79; SEQ ID NO:81; SEQ ID NO:83; SEQ ID NO:85; SEQ ID NO:87; SEQ ID NO:89; SEQ ID NO:91; SEQ ID NO:93; SEQ ID NO:95; SEQ ID NO:97; SEQ ID NO:99; SEQ ID NO:101; SEQ ID NO:103; SEQ ID NO:105; SEQ ID NO:107; SEQ ID NO:109; SEQ ID NO:111; SEQ ID NO:113; SEQ ID NO:115; SEQ ID NO:117; SEQ ID NO:119; SEQ ID NO:121; SEQ ID NO:123; SEQ ID NO:125; SEQ ID NO:127; SEQ ID NO:129; SEQ ID NO:131; SEQ ID NO:133; SEQ ID NO:135; SEQ ID NO:137; SEQ ID NO:139; SEQ ID NO:141; SEQ ID NO:143; SEQ ID NO:145; SEQ ID NO:146; SEQ ID NO:150; SEQ ID NO:158; SEQ ID NO:164; SEQ ID NO:171; SEQ ID NO:179; SEQ ID NO:187; SEQ ID NO:193; SEQ ID NO:199; SEQ ID NO:204; SEQ ID NO:210; SEQ ID NO:218; SEQ ID NO:222; SEQ ID NO:229; SEQ ID NO:234; SEQ ID NO:241; SEQ ID NO:248 and/or SEQ ID NO:254, over a region of at least about 10, 15, 20, 25, 30, 35, 40, 45, 50, 75, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550, 1600, 1650, 1700, 1750, 1800, 1850, 1900, 1950, 2000, 2050, 2100, 2200, 2250, 2300, 2350, 2400, 2450, 2500, or more residues, encodes at least one polypeptide having a protease activity, and the sequence identities are determined by analysis with a sequence comparison algorithm or by a visual inspection.

Exemplary nucleic acids of the invention also include isolated or recombinant nucleic acids encoding a polypeptide having a sequence as set forth in SEQ ID NO:2; SEQ ID NO:4; SEQ ID NO:6; SEQ ID NO:8; SEQ ID NO:10; SEQ ID NO:12; SEQ ID NO:14; SEQ ID NO:16; SEQ ID NO:18; SEQ ID NO:20; SEQ ID NO:22; SEQ ID NO:24; SEQ ID NO:26; SEQ ID NO:28; SEQ ID NO:30; SEQ ID NO:32; SEQ ID NO:34; SEQ ID NO:36; SEQ ID NO:38; SEQ ID NO:40; SEQ ID NO:42; SEQ ID NO:44; SEQ ID NO:46; SEQ ID NO:48; SEQ ID NO:50; SEQ ID NO:52; SEQ ID NO:54; SEQ ID NO:56; SEQ ID NO:58; SEQ ID NO:60; SEQ ID NO:62; SEQ ID NO:64; SEQ ID NO:66; SEQ ID NO:68; SEQ ID NO:70; SEQ ID NO:72; SEQ ID NO:74; SEQ ID NO:76; SEQ ID NO:78; SEQ ID NO:80; SEQ ID NO:82; SEQ ID NO:84; SEQ ID NO:86; SEQ ID NO:88; SEQ ID NO:90; SEQ ID NO:92; SEQ ID NO:94; SEQ ID NO:96; SEQ ID NO:98; SEQ ID NO:100; SEQ ID NO:102; SEQ ID NO:104; SEQ ID NO:106; SEQ ID NO:108; SEQ ID NO:110; SEQ ID NO:112; SEQ ID NO:114; SEQ ID NO:116; SEQ ID NO:118; SEQ ID NO:120; SEQ ID NO:122; SEQ ID NO:124; SEQ ID NO:126; SEQ ID NO:128; SEQ ID NO:130; SEQ ID NO:132; SEQ ID NO:134; SEQ ID NO:136; SEQ ID NO:138; SEQ ID NO:140; SEQ ID NO:142; SEQ ID NO:144; SEQ ID NO:147; SEQ ID NO:151; SEQ ID NO:159; SEQ ID NO:165; SEQ ID NO:172; SEQ ID NO:180; SEQ ID NO:188; SEQ ID NO:194; SEQ ID NO:200; SEQ ID NO:205; SEQ ID NO:211; SEQ ID NO:219; SEQ ID NO:223; SEQ ID NO:230; SEQ ID NO:235; SEQ ID NO:242; SEQ ID NO:249 or SEQ ID NO:255, or a polypeptide encoded by SEQ ID NO:145, and subsequences thereof and variants thereof. In one aspect, the polypeptide has a protease activity.

The following list summarizes polypeptide sequence and nucleic acid coding sequence relationships between exemplary sequences of the invention; for examples, SEQ ID NO:2 is encoded by SEQ ID NO:1, SEQ ID NO:255 is encoded by SEQ ID NO:254, etc.).

| DNA SEQ ID NOS: | Protein SEQ ID NOS: |
|---|---|
| 1 | 2 |
| 3 | 4 |
| 5 | 6 |
| 7 | 8 |
| 9 | 10 |
| 11 | 12 |
| 13 | 14 |
| 15 | 16 |
| 17 | 18 |
| 19 | 20 |
| 21 | 22 |
| 23 | 24 |
| 25 | 26 |
| 27 | 28 |
| 29 | 30 |
| 31 | 32 |
| 33 | 34 |
| 35 | 36 |
| 37 | 38 |
| 39 | 40 |
| 41 | 42 |
| 43 | 44 |
| 45 | 46 |
| 47 | 48 |

-continued

| DNA SEQ ID NOS: | Protein SEQ ID NOS: |
|---|---|
| 49 | 50 |
| 51 | 52 |
| 53 | 54 |
| 55 | 56 |
| 57 | 58 |
| 59 | 60 |
| 61 | 62 |
| 63 | 64 |
| 65 | 66 |
| 67 | 68 |
| 69 | 70 |
| 71 | 72 |
| 73 | 74 |
| 75 | 76 |
| 77 | 78 |
| 79 | 80 |
| 81 | 82 |
| 83 | 84 |
| 85 | 86 |
| 87 | 88 |
| 89 | 90 |
| 91 | 92 |
| 93 | 94 |
| 95 | 96 |
| 97 | 98 |
| 99 | 100 |
| 101 | 102 |
| 103 | 104 |
| 105 | 106 |
| 107 | 108 |
| 109 | 110 |
| 111 | 112 |
| 113 | 114 |
| 115 | 116 |
| 117 | 118 |
| 119 | 120 |
| 121 | 122 |
| 123 | 124 |
| 125 | 126 |
| 127 | 128 |
| 129 | 130 |
| 131 | 132 |
| 133 | 134 |
| 135 | 136 |
| 137 | 138 |
| 139 | 140 |
| 141 | 142 |
| 143 | 144 |
| 145 | N/A |
| 146 | 147 |
| 150 | 151 |
| 158 | 159 |
| 164 | 165 |
| 171 | 172 |
| 179 | 180 |
| 187 | 188 |
| 193 | 194 |
| 199 | 200 |
| 204 | 205 |
| 210 | 211 |
| 218 | 219 |
| 222 | 223 |
| 229 | 230 |
| 234 | 235 |
| 241 | 242 |
| 248 | 249 |
| 254 | 255 |

In one aspect, the invention also provides proteases, and protease-encoding nucleic acids, with a common novelty in that they were initially isolated/derived from mixed cultures. The invention provides protease-encoding nucleic acids isolated from mixed cultures comprising a nucleic acid sequence having at least about 10, 15, 20, 25, 30, 35, 40, 45, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary nucleic acid of the invention, e.g., SEQ ID NO:1; SEQ ID NO:3; SEQ ID NO:5; SEQ ID NO:7; SEQ ID NO:9; SEQ ID NO:11; SEQ ID NO:13; SEQ ID NO:15; SEQ ID NO:17; SEQ ID NO:19; SEQ ID NO:21; SEQ ID NO:23; SEQ ID NO:25; SEQ ID NO:27; SEQ ID NO:29; SEQ ID NO:31; SEQ ID NO:33; SEQ ID NO:35; SEQ ID NO:37; SEQ ID NO:39; SEQ ID NO:41; SEQ ID NO:43; SEQ ID NO:45; SEQ ID NO:47; SEQ ID NO:49; SEQ ID NO:51; SEQ ID NO:53; SEQ ID NO:55; SEQ ID NO:57; SEQ ID NO:59; SEQ ID NO:61; SEQ ID NO:63; SEQ ID NO:65; SEQ ID NO:67; SEQ ID NO:69; SEQ ID NO:71; SEQ ID NO:73; SEQ ID NO:75; SEQ ID NO:77; SEQ ID NO:79; SEQ ID NO:81; SEQ ID NO:83; SEQ ID NO:85; SEQ ID NO:87; SEQ ID NO:89; SEQ ID NO:91; SEQ ID NO:93; SEQ ID NO:95; SEQ ID NO:97; SEQ ID NO:99; SEQ ID NO:101; SEQ ID NO:103; SEQ ID NO:105; SEQ ID NO:107; SEQ ID NO:109; SEQ ID NO:111; SEQ ID NO:113; SEQ ID NO:115; SEQ ID NO:117; SEQ ID NO:119; SEQ ID NO:121; SEQ ID NO:123; SEQ ID NO:125; SEQ ID NO:127; SEQ ID NO:129; SEQ ID NO:131; SEQ ID NO:133; SEQ ID NO:135; SEQ ID NO:137; SEQ ID NO:139; SEQ ID NO:141; SEQ ID NO:143; SEQ ID NO:145; SEQ ID NO:146; SEQ ID NO:150; SEQ ID NO:158; SEQ ID NO:164; SEQ ID NO:171; SEQ ID NO:179; SEQ ID NO:187; SEQ ID NO:193; SEQ ID NO:199; SEQ ID NO:204; SEQ ID NO:210; SEQ ID NO:218; SEQ ID NO:222; SEQ ID NO:229; SEQ ID NO:234; SEQ ID NO:241; SEQ ID NO:248 and/or SEQ ID NO:254, over a region of at least about 50, 75, 100, 150, 200, 250, 300, 350, 400, 450, 500, 550, 600, 650, 700, 750, 800, 850, 900, 950, 1000, 1050, 1100, 1150, or more.

In one aspect, the invention also provides proteases, and protease-encoding nucleic acids, with a common novelty in that were initially derived from a common source, e.g., an archeal source, a bacterial source, a fungal source (e.g., filamentous ascomycetes, such as *Cochliobolus heterostrophus*, e.g., *C. heterostrophus* strain C4, having ATCC accession no. 48331), or an environmental source, e.g., a mixed environmental source, e.g., as set forth below.

| SEQ ID NO: | Source |
|---|---|
| 1, 2 | Archea |
| 17, 18 | Archea |
| 63, 64 | Archea |
| 15, 16 | Bacteria |
| 13, 14 | Bacteria |
| 5, 6 | Bacteria |
| 3, 4 | Bacteria |
| 57, 58 | Bacteria |
| 7, 8 | Bacteria |

187, 188 *Cochliobolus heterostrophus* strain C4 (ATCC 48331)

210, 211 *Cochliobolus heterostrophus* strain C4 (ATCC 48331)

234, 235 *Cochliobolus heterostrophus* strain C4 (ATCC 48331)

164, 165 *Cochliobolus heterostrophus* strain C4 (ATCC 48331)

199, 200 *Cochliobolus heterostrophus* strain C4 (ATCC 48331)
229, 230 *Cochliobolus heterostrophus* strain C4 (ATCC 48331)
158, 159 *Cochliobolus heterostrophus* strain C4 (ATCC 48331)
193, 194 *Cochliobolus* heterostrophus strain C4 (ATCC 48331)
222, 223 *Cochliobolus heterostrophus* strain C4 (ATCC 48331)
179, 180 *Cochliobolus heterostrophus* strain C4 (ATCC 48331)
218, 219 *Cochliobolus heterostrophus* strain C4 (ATCC 48331)
150, 151 *Cochliobolus heterostrophus* strain C4 (ATCC 48331)
171, 172 *Cochliobolus heterostrophus* strain C4 (ATCC 48331)
204, 205 *Cochliobolus heterostrophus* strain C4 (ATCC 48331)
254, 255 *Cochliobolus heterostrophus* strain C4 (ATCC 48331)
248, 249 *Cochliobolus heterostrophus* strain C4 (ATCC 48331)
241, 242 *Cochliobolus heterostrophus* strain C4 (ATCC 48331)

| | |
|---|---|
| 85, 86 | Environmental |
| 11, 12 | Environmental |
| 121, 122 | Environmental |
| 117, 118 | Environmental |
| 119, 120 | Environmental |
| 83, 84 | Environmental |
| 9, 10 | Environmental |
| 93, 94 | Environmental |
| 101, 102 | Environmental |
| 127, 128 | Environmental |
| 129, 130 | Environmental |
| 139, 140 | Environmental |
| 146, 147 | Environmental |
| 33, 34 | Environmental |
| 113, 114 | Environmental |
| 39, 40 | Environmental |
| 71, 72 | Environmental |
| 133, 134 | Environmental |
| 45, 46 | Environmental |
| 77, 78 | Environmental |
| 19, 20 | Environmental |
| 59, 60 | Environmental |
| 41, 42 | Environmental |
| 111, 112 | Environmental |
| 123, 124 | Environmental |
| 125, 126 | Environmental |
| 107, 108 | Environmental |
| 109, 110 | Environmental |
| 79, 80 | Environmental |
| 23, 24 | Environmental |
| 27, 28 | Environmental |
| 143, 144 | Environmental |
| 69, 70 | Environmental |
| 141, 142 | Environmental |
| 55, 56 | Environmental |
| 61, 62 | Environmental |
| 73, 74 | Environmental |
| 87, 88 | Environmental |
| 37, 38 | Environmental |
| 47, 48 | Environmental |
| 51, 52 | Environmental |
| 65, 66 | Environmental |
| 29, 30 | Environmental |
| 67, 68 | Environmental |
| 25, 26 | Environmental |
| 75, 76 | Environmental |

-continued

| | |
|---|---|
| 81, 82 | Environmental |
| 31, 32 | Environmental |
| 35, 36 | Environmental |
| 43, 44 | Environmental |
| 49, 50 | Environmental |
| 137, 138 | Environmental |
| 131, 132 | Environmental |
| 95, 96 | Environmental |
| 103, 104 | Environmental |
| 135, 136 | Environmental |
| 145 | Environmental |
| 105, 106 | Environmental |
| 99, 100 | Environmental |
| 97, 98 | Environmental |
| 89, 90 | Environmental |
| 91, 92 | Environmental |
| 21, 22 | Environmental |
| 115, 116 | Environmental |
| 53, 54 | Environmental |

For example (referring to the above list), the proteases, and protease-encoding nucleic acids, as set forth in SEQ ID NO:2 (encoded by SEQ ID NO:1), SEQ ID NO:18 (encoded by SEQ ID NO:17), SEQ ID NO:64 (encoded by SEQ ID NO:63) and SEQ ID NO:16 (encoded by SEQ ID NO:15) have a common novelty in that were initially derived from an archeal source, etc. with polypeptides and nucleic acids initially derived from bacterial, fungal (*Cochliobolus heterostrophus*), or environmental sources.

In one aspect, the invention provides proteases, and protease-encoding nucleic acids, initially isolated/derived from environmental sources, e.g., mixed environmental sources, comprising a nucleic acid sequence having at least about 10, 15, 20, 25, 30, 35, 40, 45, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary nucleic acid of the invention over a region of at least about 50, 75, 100, 150, 200, 250, 300, 350, 400, 450, 500, 550, 600, 650, 700, 750, 800, 850, 900, 950, 1000, 1050, 1100, 1150, 1200 or more, residues, wherein the nucleic acid encodes at least one polypeptide having a protease activity, and the sequence identities are determined by analysis with a sequence comparison algorithm or by a visual inspection.

Regarding proteases, and protease-encoding nucleic acids, of the invention with a common novelty in that they were initially derived from the filamentous ascomycetes *Cochliobolus heterostrophus*, in one aspect, these polypeptides and nucleic acids were initially isolated by growing *Cochliobolus* on either chicken feed or corn fiber, which was the sole nitrogen source. Supernatant of the media was concentrated and run on a gel. The resulting proteins isolated from the gel bands were analyzed by mass spectrometry. These proteins were sequenced and compared to the *Cochliobolus* genomic sequence. The proteases, and protease-encoding nucleic acids, of the invention initially isolated from *Cochliobolus* heterostrophus are summarized as follows:

| Protease ID | SEQ ID NO: of full gene (exons and introns) | SEQ ID NOS: of exon sequences | SEQ ID NO: of DNA sequence of coding sequence (exons only) | SEQ ID NO: of protein sequence of coding sequence (exons only) |
|---|---|---|---|---|
| A | 181 | 182-186 | 187 | 188 |
| B | 206 | 207-209 | 210 | 211 |
| C | 231 | 232-233 | 234 | 235 |
| D | 160 | 161-163 | 164 | 165 |
| E | 195 | 196-198 | 199 | 200 |
| F | 224 | 225-228 | 229 | 230 |
| G | 152 | 153-157 | 158 | 159 |
| H | 189 | 190-192 | 193 | 194 |
| I | 220 | 221 | 222 | 223 |
| J | 173 | 174-178 | 179 | 180 |
| K | 212 | 213-217 | 218 | 219 |
| L | 148 | 149 | 150 | 151 |
| M | 166 | 167-170 | 171 | 172 |
| N | 201 | 202-203 | 204 | 205 |
| O | 250 | 251-253 | 254 | 255 |
| P | 243 | 244-247 | 248 | 249 |
| Q | 236 | 237-240 | 241 | 242 |

In one aspect, the sequence comparison algorithm is a BLAST version 2.2.2 algorithm where a filtering setting is set to blastall -p blastp -d "nr pataa"-F F, and all other options are set to default.

Another aspect of the invention is an isolated or recombinant nucleic acid including at least 10 consecutive bases of a nucleic acid sequence of the invention, sequences substantially identical thereto, and the sequences complementary thereto.

In one aspect, protease activity of the invention comprises catalyzing hydrolysis of peptide bonds. The term "protease activity" includes hydrolysis of any peptide bond, including protease activity, peptidase activity and/or proteinase activity. The protease activity can comprise an endoprotease activity and/or an exoprotease activity. The protease activity can comprise a carboxypeptidase activity, an aminopeptidase activity, a serine protease activity, a metalloprotease activity (e.g., matrix metalloprotease or collagenase activity), a cysteine protease activity and/or an aspartic protease activity. In one aspect, protease activity can comprise activity the same or similar to a chymotrypsin, a trypsin, an elastase, a kallikrein and/or a subtilisin activity. The protease activity can comprise a peptidase activity, such as a dipeptidylpeptidase or a carboxypeptidase activity. In alternative aspects, the protease activity can comprise a acrocylindropepsin activity, acrosin activity, actinidin activity, acylaminoacyl-peptidase activity, ADAM 17 endopeptidase activity, ADAM10 endopeptidase activity, adamalysin activity, ADAMTS-4 endopeptidase activity, adenain activity, aeromonolysin activity, alanine carboxypeptidase activity, alpha-lytic endopeptidase activity, alternative-complement pathway C3/C5 convertase activity, aminopeptidase B activity, aminopeptidase Ey activity, aminopeptidase I activity, ananain activity, anthrax lethal factor endopeptidase activity, asclepain activity, aspartyl aminopeptidase activity, aspergillopepsin I activity, aspergillopepsin II activity, assemblin activity, astacin activity, atrolysin A activity, atrolysin B activity, atrolysin C activity, atrolysin E activity, atrolysin F activity, atroxase activity, aureolysin activity, bacillolysin activity, bacterial leucyl aminopeptidase activity, barrierpepsin activity, Beta-Ala-His dipeptidase activity, Beta-aspartyl-peptidase, beta-lytic metalloendopeptidase activity, bleomycin hydrolase activity, bontoxilysin activity, bothrolysin activity, bothropasin activity, brachyurin activity, calpain-1 activity, calpain-2 activity, cancer procoagulant activity, candidapepsin activity, carboxypeptidase A activity, carboxypeptidase A2 activity, carboxypeptidase B activity, carboxypeptidase C activity, carboxypeptidase D activity, carboxypeptidase H activity, carboxypeptidase M activity, carboxypeptidase T activity, carboxypeptidase U activity, caricain activity, caspase-1 activity, cathepsin B activity, cathepsin D activity, cathepsin E activity, cathepsin F activity, cathepsin G activity, cathepsin H activity, cathepsin K activity, cathepsin L activity, cathepsin O activity, cathepsin S activity, cathepsin T activity, cathepsin V activity, cerevisin activity, choriolysin H activity, choriolysin L activity, chymase activity, chymopapain activity, chymosin activity, chymotrypsin activity (e.g., chymotrypsin C activity), classical-complement pathway C3/C5 convertase, clostridial aminopeptidase activity, clostripain activity, coagulation factor IXa activity, coagulation factor VIIa activity, coagulation factor Xa activity, coagulation factor XIa activity, coagulation factor XIIa activity, coccolysin activity, complement component C1r activity, complement component C1s activity, complement factor D activity, complement factor I activity, cruzipain activity, cucumisin activity, cysteine-type carboxypeptidase activity, cystinyl aminopeptidase activity, cytosol alanyl aminopeptidase activity, cytosol nonspecific dipeptidase activity, dactylysin activity, deuterolysin activity, dipeptidase E activity, dipeptidyl-dipeptidase activity, dipeptidyl-peptidase I activity, dipeptidyl-peptidase II activity, dipeptidyl-peptidase III activity, dipeptidyl-peptidase IV activity, D-stereospecific aminopeptidase activity, endopeptidase Clp activity, endopeptidase La activity, endopeptidase So activity, endothelin-converting enzyme 1 activity, endothiapepsin activity, enteropeptidase activity, envelysin activity, fibrolase activity, ficain activity, flavastacin activity, flavirin activity, fragilysin activity, fruit bromelain activity, furin activity, gametolysin activity, gamma-D-glutamyl-meso-diaminopimelate peptidase I activity, gamma-glutamyl hydrolase activity, gamma-renin activity, gastricsin activity, gelatinase A activity, gelatinase B activity, gingipain K activity, gingipain R activity, Glu-Glu dipeptidase activity, glutamate carboxypeptidase II activity, Glutamate carboxypeptidase activity Glutamyl aminopeptidase activity, Glutamyl endopeptidase II activity, Glutamyl endopeptidase activity, Glycyl endopeptidase activity, Gly-X carboxypeptidase activity, GPR endopeptidase activity, Granzyme A activity, Granzyme B activity, Helper-component proteinase activity, Hepacivirin activity, Histolysain activity, HIV-1 retropepsin activity, HIV-2 retropepsin activity, Horrilysin activity, Hypodermin C activity, IgA-specific metalloendopeptidase activity, IgA-specific serine endopeptidase activity, Insulysin activity, Interstitial collagenase activity, Jararhagin activity, Kexin activity, Lactocepin activity, Legumain activity, Leishmanolysin activity, Leucolysin activity, Leucyl aminopeptidase activity, Leucyl endopeptidase activity, Leukocyte elastase activity, Limulus clotting enzyme activity, Limulus clotting factor B activity, Limulus clotting factor C activity, L-peptidase activity, Lysine(arginine) carboxypeptidase activity, Lysosomal Pro-X carboxypeptidase activity, Lysostaphin activity, Lysyl aminopeptidase activity, Lysyl endopeptidase activity, Macrophage elastase activity, Magnolysin activity, Matrilysin activity, Memapsin 1, Memapsin 2, Membrane alanine aminopeptidase, Membrane dipeptidase, Membrane Pro-X carboxypeptidase, Membrane-type matrix metalloproteinase-1, Meprin A, Meprin B, Metallocarboxypeptidase D, Methionyl aminopeptidase, Metridin, Met-Xaa dipeptidase, Microbial collagenase, Mitochondrial intermediate peptidase, Mitochondrial processing peptidase, Mucoropepsin, Mucrolysin, Muramoylpentapeptide carboxypeptidase, Muramoyltetrapeptide carboxypeptidase, Mycolysin, Myeloblastin, Nardilysin, Neopenthesin, Neprilysin, Neurolysin, Neutrophil collagenase, N-formylmethionyl-peptidase, Nodavirus endopeptidase, Non-stereospecific dipeptidase, Nuclear-inclusion-a endopeptidase, Oligopeptidase A, Oligopeptidase B, Omptin, Ophiolysin, Oryzin, O-sialoglycoprotein endopeptidase, Pancreatic elastase II, Pancreatic elastase, Pancreatic endopeptidase E, Papain, Pappalysin-1, Penicillopepsin, PepB aminopeptidase, Pepsin A, Pepsin B, Peptidyl-Asp metalloendopeptidase, Peptidyl-dipeptidase A, Peptidyl-dipeptidase B, Peptidyl-dipeptidase Dcp, Peptidyl-glycinamidase, Peptidyl-Lys metalloendopeptidase, Phytepsin, Picornain 2A, Picornain 3C, Pitrilysin, Plasma kallikrein, Plasmepsin I, Plasmepsin II, Plasmin, Plasminogen activator Pla, Polyporopepsin, Prepilin peptidase, Procollagen C-endopeptidase, Procollagen N-endopeptidase, Prolyl aminopeptidase, Prolyl oligopeptidase, Pro-opiomelanocortin converting enzyme, Proprotein convertase 1, Proprotein convertase 2, Proteasome endopeptidase complex, Protein C (activated), Proteinase K, Pseudolysin, Pycnoporopepsin, Pyroglutamyl-peptidase I, Pyroglutamyl-peptidase II, Renin, Repressor lexA, Rhizopuspepsin, Rhodotorulapepsin, Ruberlysin, Russellysin, S2P endopeptidase, Saccharolysin, Saccharopepsin, Scutelarin, Scytalidopepsin A activity, Scytalidopepsin B, Semenogelase, Separase, Serine-type D-Ala-D-Ala carboxypeptidase, Serralysin, Signal peptidase I, Signal peptidase II, Snake venom factor V activator, Snapalysin, Spermosin, Staphopain, Ste24 endopeptidase, Stem bromelain, Streptogrisin A, Streptogrisin B, Streptopain, Stromelysin 1, Stromelysin 2, Subtilisin, Tentoxilysin, Thermitase, Thermolysin, Thermomycolin, Thermopsin, Thermostable carboxypeptidase 1, Thimet oligopeptidase, Thrombin activity, Tissue kallikrein activity, Togavirin activity, T-plasminogen activator activity, Trimerelysin I activity, Trimerelysin II activity, Tripeptide aminopeptidase activity, Tripeptidyl-peptidase I activity, Tripeptidyl-peptidase II activity, Trypsin activity, Tryptase activity, Tryptophanyl aminopeptidase activity, Tubulinyl-Tyr carboxypeptidase activity, Ubiquitinyl hydrolase I activity, u-plasminogen activator activity, V-cath endopeptidase activity, Venombin A activity, Venombin AB activity, Xaa-Arg dipeptidase activity, Xaa-His dipeptidase, activity Xaa-methyl-His dipeptidase activity, Xaa-Pro aminopeptidase activity, Xaa-Pro dipeptidase activity, Xaa-Pro dipeptidyl-peptidase activity, Xaa-Trp aminopeptidase activity, Yapsin 1 activity, Zinc D-Ala-D-Ala carboxypeptidase activity or a combination thereof.

Some alternative activities of exemplary polypeptides of the invention (for example, as listed above) were determined by experimental data, by homology (sequence comparison) to other sequences, or by both sequence comparison and experimental results. However, an exemplary species of the invention, or a genus of polypeptides based on an exemplary sequence, is not limited to any specific protease activity. Thus, in alternative, but not limiting aspects, a polypeptide having a sequence as set forth in SEQ ID NO:2 (encoded by SEQ ID NO:1), can have an alkaline protease activity; a polypeptide having a sequence as set forth in SEQ ID NO:4 (encoded by SEQ ID NO:3), can have a serine protease activity; a polypeptide having a sequence as set forth in SEQ ID NO:6 (encoded by SEQ ID NO:5), can have a peptidase activity; a polypeptide having a sequence as set forth in SEQ ID NO:22 (encoded by SEQ ID NO:21, can have a serine protease activity; a polypeptide having a sequence as set forth in SEQ ID NO:26 (encoded by SEQ ID NO:25, can have a subtilisin-like secreted protease activity; a polypeptide having a sequence as set forth in SEQ ID NO:28 (encoded by SEQ ID NO:27), can have a serine protease activity (e.g., an alkaline serine protease activity); a polypeptide having a sequence as set forth in SEQ ID NO:36 (encoded by SEQ ID NO:35), can have a serine protease activity (e.g., an alkaline serine protease activity); a polypeptide having a sequence as set forth in SEQ ID NO:38 (encoded by SEQ ID NO:37), can have a serine protease activity; a polypeptide having a sequence as set forth in SEQ ID NO:42 (encoded by SEQ ID NO:41), can have a serine protease activity (e.g., an extracellular alkaline serine protease 2 activity); a polypeptide having a sequence as set forth in SEQ ID NO:50 (encoded by SEQ ID NO:49), can have a serine protease activity (e.g., an alkaline serine protease activity); a polypeptide having a sequence as set forth in SEQ ID NO:58 (encoded by SEQ ID NO:57), can have a serine protease activity; a polypeptide having a sequence as set forth in SEQ ID NO:68 (encoded by SEQ ID NO:67), can have a serine protease activity (e.g., an alkaline serine protease activity); a polypeptide having a sequence as set forth in SEQ ID NO:74 (encoded by SEQ ID NO:73), can have a serine protease activity (e.g., an alkaline serine protease activity); a polypeptide having a sequence as set forth in SEQ ID NO:76 (encoded by SEQ ID NO:75), can have a serine protease activity (e.g., a cold-active serine alkaline protease activity); a polypeptide having a sequence as set forth in SEQ ID NO:82 (encoded by SEQ ID NO:81), can have a serine protease activity; a polypeptide having a sequence as set forth in SEQ ID NO:86 (encoded by SEQ ID NO:85), can have a protease II activity; a polypeptide having a sequence as set forth in SEQ ID NO:90 (encoded by SEQ ID NO:89), can have a serine metalloprotease activity; a polypeptide having a sequence as set forth in SEQ ID NO:92 (encoded by SEQ ID NO:91), can have a metalloprotease activity; a polypeptide having a sequence as set forth in SEQ ID NO:96 (encoded by SEQ ID NO:95), can have a serine protease activity (e.g., a cold-active serine alkaline protease activity); a polypeptide having a sequence as set forth in SEQ ID NO:98 (encoded by SEQ ID NO:97), can have a peptidase activity; a polypeptide having a sequence as set forth in SEQ ID NO:100 (encoded by SEQ ID NO:99), can have a prohormone convertase activity; a polypeptide having a sequence as set forth in SEQ ID NO:106 (encoded by SEQ ID NO:105), can have a collagenase activity; a polypeptide having a sequence as set forth in SEQ ID NO:112 (encoded by SEQ ID NO:111), can have an alkaline serine protease II activity; a polypeptide having a sequence as set forth in SEQ ID NO:114 (encoded by SEQ ID NO:113), can have a serine proteinase activity; a polypeptide having a sequence as set forth in SEQ ID NO:120 (encoded by SEQ ID NO:119), can have a subtilisin-like proteinase activity; a polypeptide having a sequence as set forth in SEQ ID NO:128 (encoded by SEQ ID NO:127), can have a serine proteinase activity (e.g., serine protease A activity); a polypeptide having a sequence as set forth in SEQ ID NO:134 (encoded by SEQ ID NO:133), can have a leucine aminopeptidase activity; a polypeptide having a sequence as set forth in SEQ ID NO:136 (encoded by SEQ ID NO:135), can have a collagenase activity; a polypeptide having a sequence as set forth in SEQ ID NO:142 (encoded by SEQ ID NO:142), can have a neutral proteinase activity; a polypeptide having a sequence as set forth in SEQ ID NO:146 (encoded by SEQ ID NO:147), can have a serine protease activity; a polypeptide having a sequence as set forth in SEQ ID NO:151 (encoded by SEQ ID NO:150), can have a metalloproteinase activity or an aspartyl proteinase (aspartyl protease) activity; a polypeptide having a sequence as set forth in SEQ ID NO:159 (encoded by SEQ ID NO:158), can have a metalloproteinase activity or an carboxypeptidase activity (e.g., a serine-type carboxypeptidase activity); a sequence as set forth in SEQ ID NO:165 (encoded by SEQ ID NO:164), can have a peptidase activity, such as an aminopeptidase activity (e.g., a leucine aminopeptidase activity); a polypeptide having a sequence as set forth in SEQ ID NO:172 (encoded by SEQ ID NO:171), can have a peptidase or a CaaX prenyl protease activity (e.g., a CaaX processing activity); a polypeptide having a sequence as set forth in SEQ ID NO:180 (encoded by SEQ ID NO:179), can have a carboxypeptidase activity (e.g., a zinc carboxypeptidase activity); a polypeptide having a sequence as set forth in SEQ ID NO:188 (encoded by SEQ ID NO:187), can have a serine proteinase activity or a subtilase-like activity; a polypeptide having a sequence as set forth in SEQ ID NO:194 (encoded by SEQ ID NO:193), can have a metalloproteinase activity or a peptidase activity (e.g., an aminopeptidase activity); a polypeptide having a sequence as set forth in SEQ ID NO:200 (encoded by SEQ ID NO:199), can have a carboxypeptidase activity (e.g., a carboxypeptidase A activity or a zinc carboxypeptidase activity); a polypeptide having a sequence as set forth in SEQ ID NO:205 (encoded by SEQ ID NO:204), can have a carboxypeptidase activity (e.g., a zinc carboxypeptidase activity); a polypeptide having a sequence as set forth in SEQ ID NO:211 (encoded by SEQ ID NO:210), can have a carboxypeptidase activity (e.g., a carboxypeptidase S1 activity or a serine carboxypeptidase activity); a polypeptide having a sequence as set forth in SEQ ID NO:218 (encoded by SEQ ID NO:219), can have a zinc carboxypeptidase activity; a polypeptide having a sequence as set forth in SEQ ID NO:223 (encoded by SEQ ID NO:222), can have a peptidase activity; a polypeptide having a sequence as set forth in SEQ ID NO:230 (encoded by SEQ ID NO:229), can have an alkaline or serine proteinase activity or a subtilase activity; a polypeptide having a sequence as set forth in SEQ ID NO:235 (encoded by SEQ ID NO:234), can have a metalloproteinase activity or an acylaminoacyl peptidase activity (e.g., a carboxypeptidase S1 activity); a polypeptide having a sequence as set forth in SEQ ID NO:242 (encoded by SEQ ID NO:241), can have a carboxypeptidase activity (e.g., a zinc carboxypeptidase activity); a polypeptide having a sequence as set forth in SEQ ID NO:248 (encoded by SEQ ID NO:249), can have an aspartyl protease activity; a polypeptide having a sequence as set forth in SEQ ID NO:255 (encoded by SEQ ID NO:254), can have a metalloproteinase activity or an carboxypeptidase activity (e.g., a serine-type carboxypeptidase activity). Any polypeptide of the invention, including polypeptides having the above-listed exemplary activities, may need processing (e.g., processing of a prepro form, phosphorylation, prenylation, dimerization, etc.) to generate the enzymatically active form of the enzyme.

In one aspect, the isolated or recombinant nucleic acid encodes a polypeptide having a protease activity which is thermostable. The polypeptide can retain a protease activity under conditions comprising a temperature range of between about 37° C. to about 95° C.; between about 55° C. to about 85° C., between about 70° C. to about 95° C., or, between about 90° C. to about 95° C.

In another aspect, the isolated or recombinant nucleic acid encodes a polypeptide having a protease activity which is thermotolerant. The polypeptide can retain a protease activity after exposure to a temperature in the range from greater than 37° C. to about 95° C. or anywhere in the range from greater than 55° C. to about 85° C. The polypeptide can retain a protease activity after exposure to a temperature in the range between about 1° C. to about 5° C., between about 5° C. to about 15° C., between about 15° C. to about 25° C., between about 25° C. to about 37° C., between about 37° C. to about 95° C., between about 55° C. to about 85° C., between about 70° C. to about 75° C., or between about 90° C. to about 95° C., or more. In one aspect, the polypeptide retains a protease activity after exposure to a temperature in the range from greater than 90° C. to about 95° C. at pH 4.5.

The invention provides isolated or recombinant nucleic acids comprising a sequence that hybridizes under stringent conditions to a nucleic acid comprising a sequence as set forth in SEQ ID NO:1; SEQ ID NO:3; SEQ ID NO:5; SEQ ID NO:7; SEQ ID NO:9; SEQ ID NO:11; SEQ ID NO:13; SEQ ID NO:15; SEQ ID NO:17; SEQ ID NO:19; SEQ ID NO:21; SEQ ID NO:23; SEQ ID NO:25; SEQ ID NO:27; SEQ ID NO:29; SEQ ID NO:31; SEQ ID NO:33; SEQ ID NO:35; SEQ ID NO:37; SEQ ID NO:39; SEQ ID NO:41; SEQ ID NO:43; SEQ ID NO:45; SEQ ID NO:47; SEQ ID NO:49; SEQ ID NO:51; SEQ ID NO:53; SEQ ID NO:55; SEQ ID NO:57; SEQ ID NO:59; SEQ ID NO:61; SEQ ID NO:63; SEQ ID NO:65; SEQ ID NO:67; SEQ ID NO:69; SEQ ID NO:71; SEQ ID NO:73; SEQ ID NO:75; SEQ ID NO:77; SEQ ID NO:79; SEQ ID NO:81; SEQ ID NO:83; SEQ ID NO:85; SEQ ID NO:87; SEQ ID NO:89; SEQ ID NO:91; SEQ ID NO:93; SEQ ID NO:95; SEQ ID NO:97; SEQ ID NO:99; SEQ ID NO:101; SEQ ID NO:103; SEQ ID NO:105; SEQ ID NO:107; SEQ ID NO:109; SEQ ID NO:111; SEQ ID NO:113; SEQ ID NO:115; SEQ ID NO:117; SEQ ID NO:119; SEQ ID NO:121; SEQ ID NO:123; SEQ ID NO:125; SEQ ID NO:127; SEQ ID NO:129; SEQ ID NO:131; SEQ ID NO:133; SEQ ID NO:135; SEQ ID NO:137; SEQ ID NO:139; SEQ ID NO:141; SEQ ID NO:143; SEQ ID NO:145; SEQ ID NO:146; SEQ ID NO:150; SEQ ID NO:158; SEQ ID NO:164; SEQ ID NO:171; SEQ ID NO:179; SEQ ID NO:187; SEQ ID NO:193; SEQ ID NO:199; SEQ ID NO:204; SEQ ID NO:210; SEQ ID NO:218; SEQ ID NO:222; SEQ ID NO:229; SEQ ID NO:234; SEQ ID NO:241; SEQ ID NO:248 and/or SEQ ID NO:254, or fragments or subsequences thereof. In one aspect, the nucleic acid encodes a polypeptide having a protease activity. The nucleic acid can be at least about 10, 15, 20, 25, 30, 35, 40, 45, 50, 75, 100, 150, 200, 250, 300, 350, 400, 450, 500, 550, 600, 650, 700, 750, 800, 850, 900, 950, 1000, 1050, 1100, 1150, 1200 or more residues in length or the full length of the gene or transcript. In one aspect, the stringent conditions include a wash step comprising a wash in 0.2×SSC at a temperature of about 65° C. for about 15 minutes.

The invention provides a nucleic acid probe for identifying a nucleic acid encoding a polypeptide having a protease activity, wherein the probe comprises at least about 10, 15, 20, 25, 30, 35, 40, 45, 50, 55, 60, 65, 70, 75, 80, 85, 90, 95, 100, 150, 200, 250, 300, 350, 400, 450, 500, 550, 600, 650, 700, 750, 800, 850, 900, 950, 1000 or more, consecutive bases of a sequence comprising a sequence of the invention, or fragments or subsequences thereof, wherein the probe identifies the nucleic acid by binding or hybridization. The probe can comprise an oligonucleotide comprising at least about 10 to 50, about 20 to 60, about 30 to 70, about 40 to 80, or about 60 to 100 consecutive bases of a sequence comprising a sequence of the invention, or fragments or subsequences thereof.

The invention provides a nucleic acid probe for identifying a nucleic acid encoding a polypeptide having a protease activity, wherein the probe comprises a nucleic acid comprising a sequence at least about 10, 15, 20, 30, 40, 50, 60, 70, 80, 90, 100, 150, 200, 250, 300, 350, 400, 450, 500, 550, 600, 650, 700, 750, 800, 850, 900, 950, 1000 or more residues having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to a nucleic acid of the invention, wherein the sequence identities are determined by analysis with a sequence comparison algorithm or by visual inspection.

The probe can comprise an oligonucleotide comprising at least about 10 to 50, about 20 to 60, about 30 to 70, about 40 to 80, or about 60 to 100 consecutive bases of a nucleic acid sequence of the invention, or a subsequence thereof.

The invention provides an amplification primer pair for amplifying a nucleic acid encoding a polypeptide having a protease activity, wherein the primer pair is capable of amplifying a nucleic acid comprising a sequence of the invention, or fragments or subsequences thereof. One or each member of the amplification primer sequence pair can comprise an oligonucleotide comprising at least about 10 to 50 consecutive bases of the sequence, or about 12, 13, 14, 15, 16, 17, 18, 19, 20, 21, 22, 23, 24, 25, 26, 27, 28, 29, 30 or more consecutive bases of the sequence.

The invention provides amplification primer pairs, wherein the primer pair comprises a first member having a sequence as set forth by about the first (the 5') 12, 13, 14, 15, 16, 17, 18, 19, 20, 21, 22, 23, 24, 25, 26, 27, 28, 29, 30 or more residues of a nucleic acid of the invention, and a second member having a sequence as set forth by about the first (the 5') 12, 13, 14, 15, 16, 17, 18, 19, 20, 21, 22, 23, 24, 25, 26, 27, 28, 29, 30 or more residues of the complementary strand of the first member.

The invention provides protease-encoding nucleic acids generated by amplification, e.g., polymerase chain reaction (PCR), using an amplification primer pair of the invention. The invention provides proteases generated by amplification, e.g., polymerase chain reaction (PCR), using an amplification primer pair of the invention. The invention provides methods of making a protease by amplification, e.g., polymerase chain reaction (PCR), using an amplification primer pair of the invention. In one aspect, the amplification primer pair amplifies a nucleic acid from a library, e.g., a gene library, such as an environmental library.

The invention provides methods of amplifying a nucleic acid encoding a polypeptide having a protease activity comprising amplification of a template nucleic acid with an amplification primer sequence pair capable of amplifying a nucleic acid sequence of the invention, or fragments or subsequences thereof.

The invention provides expression cassettes comprising a nucleic acid of the invention or a subsequence thereof. In one aspect, the expression cassette can comprise the nucleic acid that is operably linked to a promoter. The promoter can be a viral, bacterial, mammalian or plant promoter. In one aspect, the plant promoter can be a potato, rice, corn, wheat, tobacco or barley promoter. The promoter can be a constitutive promoter. The constitutive promoter can comprise CaMV35S. In another aspect, the promoter can be an inducible promoter. In one aspect, the promoter can be a tissue-specific promoter or an environmentally regulated or a developmentally regulated promoter. Thus, the promoter can be, e.g., a seed-specific, a leaf-specific, a root-specific, a stem-specific or an abscission-induced promoter. In one aspect, the expression cassette can further comprise a plant or plant virus expression vector.

The invention provides cloning vehicles comprising an expression cassette (e.g., a vector) of the invention or a nucleic acid of the invention. The cloning vehicle can be a viral vector, a plasmid, a phage, a phagemid, a cosmid, a fosmid, a bacteriophage or an artificial chromosome. The viral vector can comprise an adenovirus vector, a retroviral vector or an adeno-associated viral vector. The cloning vehicle can comprise a bacterial artificial chromosome (BAC), a plasmid, a bacteriophage P1-derived vector (PAC), a yeast artificial chromosome (YAC), or a mammalian artificial chromosome (MAC).

The invention provides transformed cell comprising a nucleic acid of the invention or an expression cassette (e.g., a vector) of the invention, or a cloning vehicle of the invention. In one aspect, the transformed cell can be a bacterial cell, a mammalian cell, a fungal cell, a yeast cell, an insect cell or a plant cell. In one aspect, the plant cell can be a potato, wheat, rice, corn, tobacco or barley cell.

The invention provides transgenic non-human animals comprising a nucleic acid of the invention or an expression cassette (e.g., a vector) of the invention. In one aspect, the animal is a mouse.

The invention provides transgenic plants comprising a nucleic acid of the invention or an expression cassette (e.g., a vector) of the invention. The transgenic plant can be a corn plant, a potato plant, a tomato plant, a wheat plant, an oilseed plant, a rapeseed plant, a soybean plant, a rice plant, a barley plant or a tobacco plant.

The invention provides transgenic seeds comprising a nucleic acid of the invention or an expression cassette (e.g., a vector) of the invention. The transgenic seed can be a corn seed, a wheat kernel, an oilseed, a rapeseed, a soybean seed, a palm kernel, a sunflower seed, a sesame seed, a peanut or a tobacco plant seed.

The invention provides an antisense oligonucleotide comprising a nucleic acid sequence complementary to or capable of hybridizing under stringent conditions to a nucleic acid of the invention. The invention provides methods of inhibiting the translation of a protease message in a cell comprising administering to the cell or expressing in the cell an antisense oligonucleotide comprising a nucleic acid sequence complementary to or capable of hybridizing under stringent conditions to a nucleic acid of the invention. In one aspect, the antisense oligonucleotide is between about 10 to 50, about 20 to 60, about 30 to 70, about 40 to 80, or about 60 to 100 bases in length.

The invention provides methods of inhibiting the translation of a protease message in a cell comprising administering to the cell or expressing in the cell an antisense oligonucleotide comprising a nucleic acid sequence complementary to or capable of hybridizing under stringent conditions to a nucleic acid of the invention. The invention provides double-stranded inhibitory RNA (RNAi) molecules comprising a subsequence of a sequence of the invention. In one aspect, the RNAi is about 15, 16, 17, 18, 19, 20, 21, 22, 23, 24, 25 or more duplex nucleotides in length. The invention provides methods of inhibiting the expression of a protease in a cell comprising administering to the cell or expressing in the cell a double-stranded inhibitory RNA (iRNA), wherein the RNA comprises a subsequence of a sequence of the invention.

The invention provides an isolated or recombinant polypeptide comprising an amino acid sequence having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary polypeptide or peptide of the invention over a region of at least about 25, 50, 75, 100, 125, 150, 175, 200, 225, 250, 275, 300, 325, 350 or more residues, or over the full length of the polypeptide, and the sequence identities are determined by analysis with a sequence comparison algorithm or by a visual inspection. Exemplary polypeptide or peptide sequences of the invention include SEQ ID NO:2; SEQ ID NO:4; SEQ ID NO:6; SEQ ID NO:8; SEQ ID NO:10; SEQ ID NO:12; SEQ ID NO:14; SEQ ID NO:16; SEQ ID NO:18; SEQ ID NO:20; SEQ ID NO:22; SEQ ID NO:24; SEQ ID NO:26; SEQ ID NO:28; SEQ ID NO:30; SEQ ID NO:32; SEQ ID NO:34; SEQ ID NO:36; SEQ ID NO:38; SEQ ID NO:40; SEQ ID NO:42; SEQ ID NO:44; SEQ ID NO:46; SEQ ID NO:48; SEQ ID NO:50; SEQ ID NO:52; SEQ ID NO:54; SEQ ID NO:56; SEQ ID NO:58; SEQ ID NO:60; SEQ ID NO:62; SEQ ID NO:64; SEQ ID NO:66; SEQ ID NO:68; SEQ ID NO:70; SEQ ID NO:72; SEQ ID NO:74; SEQ ID NO:76; SEQ ID NO:78; SEQ ID NO:80; SEQ ID NO:82; SEQ ID NO:84; SEQ ID NO:86; SEQ ID NO:88; SEQ ID NO:90; SEQ ID NO:92; SEQ ID NO:94; SEQ ID NO:96; SEQ ID NO:98; SEQ ID NO:100; SEQ ID NO:102; SEQ ID NO:104; SEQ ID NO:106; SEQ ID NO:108; SEQ ID NO:110; SEQ ID NO:112; SEQ ID NO:114; SEQ ID NO:116; SEQ ID NO:118; SEQ ID NO:120; SEQ ID NO:122; SEQ ID NO:124; SEQ ID NO:126; SEQ ID NO:128; SEQ ID NO:130; SEQ ID NO:132; SEQ ID NO:134; SEQ ID NO:136; SEQ ID NO:138; SEQ ID NO:140; SEQ ID NO:142; SEQ ID NO:144; SEQ ID NO:147; SEQ ID NO:151; SEQ ID NO:159; SEQ ID NO:165; SEQ ID NO:172; SEQ ID NO:180; SEQ ID NO:188; SEQ ID NO:194; SEQ ID NO:200; SEQ ID NO:205; SEQ ID NO:211; SEQ ID NO:219; SEQ ID NO:223; SEQ ID NO:230; SEQ ID NO:235; SEQ ID NO:242; SEQ ID NO:249 or SEQ ID NO:255, or a protease encoded by SEQ ID NO:145, and subsequences thereof and variants thereof. Exemplary polypeptides also include fragments of at least about 10, 15, 20, 25, 30, 35, 40, 45, 50, 75, 100, 150, 200, 250, 300, 350, 400, 450, 500, 550, 600 or more residues in length, or over the full length of an enzyme. Exemplary polypeptide or peptide sequences of the invention include sequence encoded by a nucleic acid of the invention. Exemplary polypeptide or peptide sequences of the invention include polypeptides or peptides specifically bound by an antibody of the invention. In one aspect, a polypeptide of the invention can have at least one protease activity.

Another aspect of the invention provides an isolated or recombinant polypeptide or peptide including at least 10, 15, 20, 25, 30, 35, 40, 45, 50, 55, 60, 65, 70, 75, 80, 85, 90, 95 or 100 or more consecutive bases of a polypeptide or peptide sequence of the invention, sequences substantially identical thereto, and the sequences complementary thereto. The peptide can be, e.g., an immunogenic fragment, a motif (e.g., a binding site), a signal sequence (e.g., as in Table 4), a prepro sequence or an active site.

In one aspect, protease activity comprises catalyzing hydrolysis of peptide bonds. The protease activity can comprise an endoprotease activity and/or an exoprotease activity. The protease activity can comprise a carboxypeptidase activity, an aminopeptidase activity, a serine protease activity, a metalloprotease activity, a cysteine protease activity and/or an aspartic protease activity. In one aspect, protease activity can comprise activity the same or similar to a chymotrypsin, a trypsin, an elastase, a kallikrein and/or a subtilisin activity. The protease activity can comprise a peptidase activity, such as a dipeptidylpeptidase or a carboxypeptidase activity.

In one aspect, the protease activity is thermostable. The polypeptide can retain a protease activity under conditions comprising a temperature range of between about 1° C. to about 5° C., between about 5° C. to about 15° C., between about 15° C. to about 25° C., between about 25° C. to about 37° C., between about 37° C. to about 95° C., between about 55° C. to about 85° C., between about 70° C. to about 75° C., or between about 90° C. to about 95° C., or more. In another aspect, the protease activity can be thermotolerant. The polypeptide can retain a protease activity after exposure to a temperature in the range from greater than 37° C. to about 95° C., or in the range from greater than 55° C. to about 85° C. In one aspect, the polypeptide can retain a protease activity after exposure to a temperature in the range from greater than 90° C. to about 95° C. at pH 4.5.

In one aspect, the isolated or recombinant polypeptide can comprise the polypeptide of the invention that lacks a signal sequence. In one aspect, the isolated or recombinant polypeptide can comprise the polypeptide of the invention comprising a heterologous signal sequence, such as a heterologous protease or non-protease signal sequence.

In one aspect, the invention provides a signal sequence comprising a peptide comprising/consisting of a sequence as set forth in residues 1 to 12, 1 to 13, 1 to 14, 1 to 15, 1 to 16, 1 to 17, 1 to 18, 1 to 19, 1 to 20, 1 to 21, 1 to 22, 1 to 23, 1 to 24, 1 to 25, 1 to 26, 1 to 27, 1 to 28, 1 to 28, 1 to 30, 1 to 31, 1 to 32, 1 to 33, 1 to 34, 1 to 35, 1 to 36, 1 to 37, 1 to 38, 1 to 39, 1 to 40, 1 to 41, 1 to 42, 1 to 43, 1 to 44 (or a longer peptide) of a polypeptide of the invention. In one aspect, the invention provides a signal sequence comprising a peptide comprising/consisting of a sequence as set forth Table 4.

The invention provides isolated or recombinant peptides comprising an amino acid sequence having at least 95%, 96%, 97%, 98%, 99%, or more sequence identity to residues 1 to 37 of SEQ ID NO:2, at least 95%, 96%, 97%, 98%, 99%, or more sequence identity to residues 1 to 36 of SEQ ID NO:4, at least 95%, 96%, 97%, 98%, 99%, or more sequence identity to residues 1 to 32 of SEQ ID NO:6, at least 95%, 96%, 97%, 98%, 99%, or more sequence identity to residues 1 to 28 of SEQ ID NO:10, at least 95%, 96%, 97%, 98%, 99%, or more sequence identity to residues 1 to 33 of SEQ ID NO:14, and least 95%, 96%, 97%, 98%, 99%, or more sequence identity to the other signal sequences as set forth in the SEQ ID listing, wherein the sequence identities are determined by analysis with a sequence comparison algorithm or by visual inspection. These peptides can act as signal sequences on its endogenous protease, on another protease, or a heterologous protein (a non-protease enzyme or other protein).

In one aspect, the invention provides chimeric proteins comprising a first domain comprising a signal sequence of the invention (e.g., see Table 4) and at least a second domain. The protein can be a fusion protein. The second domain can comprise an enzyme. The enzyme can be a protease.

The invention provides chimeric polypeptides comprising at least a first domain comprising signal peptide (SP), a prepro sequence and/or a catalytic domain (CD) of the invention and at least a second domain comprising a heterologous polypeptide or peptide, wherein the heterologous polypeptide or peptide is not naturally associated with the signal peptide (SP), prepro sequence and/or catalytic domain (CD). In one aspect, the heterologous polypeptide or peptide is not a protease. The heterologous polypeptide or peptide can be amino terminal to, carboxy terminal to or on both ends of the signal peptide (SP), prepro sequence and/or catalytic domain (CD).

The invention provides isolated or recombinant nucleic acids encoding a chimeric polypeptide, wherein the chimeric polypeptide comprises at least a first domain comprising signal peptide (SP), a prepro domain and/or a catalytic domain (CD) of the invention and at least a second domain comprising a heterologous polypeptide or peptide, wherein the heterologous polypeptide or peptide is not naturally associated with the signal peptide (SP), prepro domain and/or catalytic domain (CD).

In one aspect, the protease activity comprises a specific activity at about 37° C. in the range from about 1 to about 1200 units per milligram of protein, or, about 100 to about 1000 units per milligram of protein. In another aspect, the protease activity comprises a specific activity from about 100 to about 1000 units per milligram of protein, or, from about 500 to about 750 units per milligram of protein. Alternatively, the protease activity comprises a specific activity at 37° C. in the range from about 1 to about 750 units per milligram of protein, or, from about 500 to about 1200 units per milligram of protein. In one aspect, the protease activity comprises a specific activity at 37° C. in the range from about 1 to about 500 units per milligram of protein, or, from about 750 to about 1000 units per milligram of protein. In another aspect, the protease activity comprises a specific activity at 37° C. in the range from about 1 to about 250 units per milligram of protein. Alternatively, the protease activity comprises a specific activity at 37° C. in the range from about 1 to about 100 units per milligram of protein. In another aspect, the thermotolerance comprises retention of at least half of the specific activity of the protease at 37° C. after being heated to the elevated temperature. Alternatively, the thermotolerance can comprise retention of specific activity at 37° C. in the range from about 1 to about 1200 units per milligram of protein, or, from about 500 to about 1000 units per milligram of protein, after being heated to the elevated temperature. In another aspect, the thermotolerance can comprise retention of specific activity at 37° C. in the range from about 1 to about 500 units per milligram of protein after being heated to the elevated temperature.

The invention provides the isolated or recombinant polypeptide of the invention, wherein the polypeptide comprises at least one glycosylation site. In one aspect, glycosylation can be an N-linked glycosylation. In one aspect, the polypeptide can be glycosylated after being expressed in a P. pastoris or a S. pombe.

In one aspect, the polypeptide can retain a protease activity under conditions comprising about pH 6.5, pH 6, pH 5.5, pH 5, pH 4.5 or pH 4. In another aspect, the polypeptide can retain a protease activity under conditions comprising about pH 7, pH 7.5 pH 8.0, pH 8.5, pH 9, pH 9.5, pH 10, pH 10.5 or pH 11. In one aspect, the polypeptide can retain a protease activity after exposure to conditions comprising about pH 6.5, pH 6, pH 5.5, pH 5, pH 4.5 or pH 4. In another aspect, the polypeptide can retain a protease activity after exposure to conditions comprising about pH 7, pH 7.5 pH 8.0, pH 8.5, pH 9, pH 9.5, pH 10, pH 10.5 or pH 11.

The invention provides protein preparations comprising a polypeptide of the invention, wherein the protein preparation comprises a liquid, a solid or a gel.

The invention provides heterodimers comprising a polypeptide of the invention and a second protein or domain. The second member of the heterodimer can be a different protease, a different enzyme or another protein. In one aspect, the second domain can be a polypeptide and the heterodimer can be a fusion protein. In one aspect, the second domain can be an epitope or a tag. In one aspect, the invention provides homodimers comprising a polypeptide of the invention.

The invention provides immobilized polypeptides having a protease activity, wherein the polypeptide comprises a polypeptide of the invention, a polypeptide encoded by a nucleic acid of the invention, or a polypeptide comprising a polypeptide of the invention and a second domain. In one aspect, the polypeptide can be immobilized on a cell, a metal, a resin, a polymer, a ceramic, a glass, a microelectrode, a graphitic particle, a bead, a gel, a plate, an array or a capillary tube.

The invention provides arrays comprising an immobilized nucleic acid of the invention. The invention provides arrays comprising an antibody of the invention.

The invention provides isolated or recombinant antibodies that specifically bind to a polypeptide of the invention or to a polypeptide encoded by a nucleic acid of the invention. The antibody can be a monoclonal or a polyclonal antibody. The invention provides hybridomas comprising an antibody of the invention, e.g., an antibody that specifically binds to a polypeptide of the invention or to a polypeptide encoded by a nucleic acid of the invention.

The invention provides food supplements for an animal comprising a polypeptide of the invention, e.g., a polypeptide encoded by the nucleic acid of the invention. In one aspect, the polypeptide in the food supplement can be glycosylated. The invention provides edible enzyme delivery matrices comprising a polypeptide of the invention, e.g., a polypeptide encoded by the nucleic acid of the invention. In one aspect, the delivery matrix comprises a pellet. In one aspect, the polypeptide can be glycosylated. In one aspect, the protease activity is thermotolerant. In another aspect, the protease activity is thermostable.

The invention provides method of isolating or identifying a polypeptide having a protease activity comprising the steps of: (a) providing an antibody of the invention; (b) providing a sample comprising polypeptides; and (c) contacting the sample of step (b) with the antibody of step (a) under conditions wherein the antibody can specifically bind to the polypeptide, thereby isolating or identifying a polypeptide having a protease activity.

The invention provides methods of making an anti-protease antibody comprising administering to a non-human animal a nucleic acid of the invention or a polypeptide of the invention or subsequences thereof in an amount sufficient to generate a humoral immune response, thereby making an anti-protease antibody. The invention provides methods of making an anti-protease immune comprising administering to a non-human animal a nucleic acid of the invention or a polypeptide of the invention or subsequences thereof in an amount sufficient to generate an immune response.

The invention provides methods of producing a recombinant polypeptide comprising the steps of: (a) providing a nucleic acid of the invention operably linked to a promoter; and (b) expressing the nucleic acid of step (a) under conditions that allow expression of the polypeptide, thereby producing a recombinant polypeptide. In one aspect, the method can further comprise transforming a host cell with the nucleic acid of step (a) followed by expressing the nucleic acid of step (a), thereby producing a recombinant polypeptide in a transformed cell.

The invention provides methods for identifying a polypeptide having a protease activity comprising the following steps: (a) providing a polypeptide of the invention; or a polypeptide encoded by a nucleic acid of the invention; (b) providing a protease substrate; and (c) contacting the polypeptide or a fragment or variant thereof of step (a) with the substrate of step (b) and detecting a decrease in the amount of substrate or an increase in the amount of a reaction product, wherein a decrease in the amount of the substrate or an increase in the amount of the reaction product detects a polypeptide having a protease activity.

The invention provides methods for identifying a protease substrate comprising the following steps: (a) providing a polypeptide of the invention; or a polypeptide encoded by a nucleic acid of the invention; (b) providing a test substrate; and (c) contacting the polypeptide of step (a) with the test substrate of step (b) and detecting a decrease in the amount of substrate or an increase in the amount of reaction product, wherein a decrease in the amount of the substrate or an increase in the amount of a reaction product identifies the test substrate as a protease substrate.

The invention provides methods of determining whether a test compound specifically binds to a polypeptide comprising the following steps: (a) expressing a nucleic acid or a vector comprising the nucleic acid under conditions permissive for translation of the nucleic acid to a polypeptide, wherein the nucleic acid comprises a nucleic acid of the invention, or, providing a polypeptide of the invention; (b) providing a test compound; (c) contacting the polypeptide with the test compound; and (d) determining whether the test compound of step (b) specifically binds to the polypeptide.

The invention provides methods for identifying a modulator of a protease activity comprising the following steps: (a) providing a polypeptide of the invention or a polypeptide encoded by a nucleic acid of the invention; (b) providing a test compound; (c) contacting the polypeptide of step (a) with the test compound of step (b) and measuring an activity of the protease, wherein a change in the protease activity measured in the presence of the test compound compared to the activity in the absence of the test compound provides a determination that the test compound modulates the protease activity. In one aspect, the protease activity can be measured by providing a protease substrate and detecting a decrease in the amount of the substrate or an increase in the amount of a reaction product, or, an increase in the amount of the substrate or a decrease in the amount of a reaction product. A decrease in the amount of the substrate or an increase in the amount of the reaction product with the test compound as compared to the amount of substrate or reaction product without the test compound identifies the test compound as an activator of protease activity. An increase in the amount of the substrate or a decrease in the amount of the reaction product with the test compound as compared to the amount of substrate or reaction product without the test compound identifies the test compound as an inhibitor of protease activity.

The invention provides computer systems comprising a processor and a data storage device wherein said data storage device has stored thereon a polypeptide sequence or a nucleic acid sequence of the invention (e.g., a polypeptide encoded by a nucleic acid of the invention). In one aspect, the computer system can further comprise a sequence comparison algorithm and a data storage device having at least one reference sequence stored thereon. In another aspect, the sequence comparison algorithm comprises a computer program that indicates polymorphisms. In one aspect, the computer system can further comprise an identifier that identifies one or more features in said sequence. The invention provides computer readable media having stored thereon a polypeptide sequence or a nucleic acid sequence of the invention. The invention provides methods for identifying a feature in a sequence comprising the steps of: (a) reading the sequence using a computer program which identifies one or more features in a sequence, wherein the sequence comprises a polypeptide sequence or a nucleic acid sequence of the invention; and (b) identifying one or more features in the sequence with the computer program. The invention provides methods for comparing a first sequence to a second sequence comprising the steps of: (a) reading the first sequence and the second sequence through use of a computer program which compares sequences, wherein the first sequence comprises a polypeptide sequence or a nucleic acid sequence of the invention; and (b) determining differences between the first sequence and the second sequence with the computer program. The step of determining differences between the first sequence and the second sequence can further comprise the step of identifying polymorphisms. In one aspect, the method can further comprise an identifier that identifies one or more features in a sequence. In another aspect, the method can comprise reading the first sequence using a computer program and identifying one or more features in the sequence.

The invention provides methods for isolating or recovering a nucleic acid encoding a polypeptide having a protease activity from an environmental sample comprising the steps of: (a) providing an amplification primer sequence pair for amplifying a nucleic acid encoding a polypeptide having a protease activity, wherein the primer pair is capable of amplifying a nucleic acid of the invention; (b) isolating a nucleic acid from the environmental sample or treating the environmental sample such that nucleic acid in the sample is accessible for hybridization to the amplification primer pair; and, (c) combining the nucleic acid of step (b) with the amplification primer pair of step (a) and amplifying nucleic acid from the environmental sample, thereby isolating or recovering a nucleic acid encoding a polypeptide having a protease activity from an environmental sample. One or each member of the amplification primer sequence pair can comprise an oligonucleotide comprising at least about 10 to 50 consecutive bases of a sequence of the invention. In one aspect, the amplification primer sequence pair is an amplification pair of the invention.

The invention provides methods for isolating or recovering a nucleic acid encoding a polypeptide having a protease activity from an environmental sample comprising the steps of: (a) providing a polynucleotide probe comprising a nucleic acid of the invention or a subsequence thereof; (b) isolating a nucleic acid from the environmental sample or treating the environmental sample such that nucleic acid in the sample is accessible for hybridization to a polynucleotide probe of step (a); (c) combining the isolated nucleic acid or the treated environmental sample of step (b) with the polynucleotide probe of step (a); and (d) isolating a nucleic acid that specifically hybridizes with the polynucleotide probe of step (a), thereby isolating or recovering a nucleic acid encoding a polypeptide having a protease activity from an environmental sample. The environmental sample can comprise a water sample, a liquid sample, a soil sample, an air sample or a biological sample. In one aspect, the biological sample can be derived from a bacterial cell, a protozoan cell, an insect cell, a yeast cell, a plant cell, a fungal cell or a mammalian cell.

The invention provides methods of generating a variant of a nucleic acid encoding a polypeptide having a protease activity comprising the steps of: (a) providing a template nucleic acid comprising a nucleic acid of the invention; and (b) modifying, deleting or adding one or more nucleotides in the template sequence, or a combination thereof, to generate a variant of the template nucleic acid. In one aspect, the method can further comprise expressing the variant nucleic acid to generate a variant protease polypeptide. The modifications, additions or deletions can be introduced by a method comprising error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, gene site saturated mutagenesis (GSSM), synthetic ligation reassembly (SLR) or a combination thereof. In another aspect, the modifications, additions or deletions are introduced by a method comprising recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation and a combination thereof.

In one aspect, the method can be iteratively repeated until a protease having an altered or different activity or an altered or different stability from that of a polypeptide encoded by the template nucleic acid is produced. In one aspect, the variant protease polypeptide is thermotolerant, and retains some activity after being exposed to an elevated temperature. In another aspect, the variant protease polypeptide has increased glycosylation as compared to the protease encoded by a template nucleic acid. Alternatively, the variant protease polypeptide has a protease activity under a high temperature, wherein the protease encoded by the template nucleic acid is not active under the high temperature. In one aspect, the method can be iteratively repeated until a protease coding sequence having an altered codon usage from that of the template nucleic acid is produced. In another aspect, the method can be iteratively repeated until a protease gene having higher or lower level of message expression or stability from that of the template nucleic acid is produced.

The invention provides methods for modifying codons in a nucleic acid encoding a polypeptide having a protease activity to increase its expression in a host cell, the method comprising the following steps: (a) providing a nucleic acid of the invention encoding a polypeptide having a protease activity; and, (b) identifying a non-preferred or a less preferred codon in the nucleic acid of step (a) and replacing it with a preferred or neutrally used codon encoding the same amino acid as the replaced codon, wherein a preferred codon is a codon over-represented in coding sequences in genes in the host cell and a non-preferred or less preferred codon is a codon under-represented in coding sequences in genes in the host cell, thereby modifying the nucleic acid to increase its expression in a host cell.

The invention provides methods for modifying codons in a nucleic acid encoding a polypeptide having a protease activity; the method comprising the following steps: (a) providing a nucleic acid of the invention; and, (b) identifying a codon in the nucleic acid of step (a) and replacing it with a different codon encoding the same amino acid as the replaced codon, thereby modifying codons in a nucleic acid encoding a protease.

The invention provides methods for modifying codons in a nucleic acid encoding a polypeptide having a protease activity to increase its expression in a host cell, the method comprising the following steps: (a) providing a nucleic acid of the invention encoding a protease polypeptide; and, (b) identifying a non-preferred or a less preferred codon in the nucleic acid of step (a) and replacing it with a preferred or neutrally used codon encoding the same amino acid as the replaced codon, wherein a preferred codon is a codon over-represented in coding sequences in genes in the host cell and a non-preferred or less preferred codon is a codon under-represented in coding sequences in genes in the host cell, thereby modifying the nucleic acid to increase its expression in a host cell.

The invention provides methods for modifying a codon in a nucleic acid encoding a polypeptide having a protease activity to decrease its expression in a host cell, the method comprising the following steps: (a) providing a nucleic acid of the invention; and (b) identifying at least one preferred codon in the nucleic acid of step (a) and replacing it with a non-preferred or less preferred codon encoding the same amino acid as the replaced codon, wherein a preferred codon is a codon over-represented in coding sequences in genes in a host cell and a non-preferred or less preferred codon is a codon under-represented in coding sequences in genes in the host cell, thereby modifying the nucleic acid to decrease its expression in a host cell. In one aspect, the host cell can be a bacterial cell, a fungal cell, an insect cell, a yeast cell, a plant cell or a mammalian cell.

The invention provides methods for producing a library of nucleic acids encoding a plurality of modified protease active sites or substrate binding sites, wherein the modified active sites or substrate binding sites are derived from a first nucleic acid comprising a sequence encoding a first active site or a first substrate binding site the method comprising the following steps: (a) providing a first nucleic acid encoding a first active site or first substrate binding site, wherein the first nucleic acid sequence comprises a sequence that hybridizes under stringent conditions to a nucleic acid of the invention, and the nucleic acid encodes a protease active site or a protease substrate binding site; (b) providing a set of mutagenic oligonucleotides that encode naturally-occurring amino acid variants at a plurality of targeted codons in the first nucleic acid; and, (c) using the set of mutagenic oligonucleotides to generate a set of active site-encoding or substrate binding site-encoding variant nucleic acids encoding a range of amino acid variations at each amino acid codon that was mutagenized, thereby producing a library of nucleic acids encoding a plurality of modified protease active sites or substrate binding sites. In one aspect, the method comprises mutagenizing the first nucleic acid of step (a) by a method comprising an optimized directed evolution system, gene site-saturation mutagenesis (GSSM), synthetic ligation reassembly (SLR), error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, gene site saturated mutagenesis (GSSM), synthetic ligation reassembly (SLR) and a combination thereof. In another aspect, the method comprises mutagenizing the first nucleic acid of step (a) or variants by a method comprising recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation and a combination thereof.

The invention provides methods for making a small molecule comprising the following steps: (a) providing a plurality of biosynthetic enzymes capable of synthesizing or modifying a small molecule, wherein one of the enzymes comprises a protease enzyme encoded by a nucleic acid of the invention; (b) providing a substrate for at least one of the enzymes of step (a); and (c) reacting the substrate of step (b) with the enzymes under conditions that facilitate a plurality of biocatalytic reactions to generate a small molecule by a series of biocatalytic reactions. The invention provides methods for modifying a small molecule comprising the following steps: (a) providing a protease enzyme, wherein the enzyme comprises a polypeptide of the invention, or, a polypeptide encoded by a nucleic acid of the invention, or a subsequence thereof; (b) providing a small molecule; and (c) reacting the enzyme of step (a) with the small molecule of step (b) under conditions that facilitate an enzymatic reaction catalyzed by the protease enzyme, thereby modifying a small molecule by a protease enzymatic reaction. In one aspect, the method can comprise a plurality of small molecule substrates for the enzyme of step (a), thereby generating a library of modified small molecules produced by at least one enzymatic reaction catalyzed by the protease enzyme. In one aspect, the method can comprise a plurality of additional enzymes under conditions that facilitate a plurality of biocatalytic reactions by the enzymes to form a library of modified small molecules produced by the plurality of enzymatic reactions. In another aspect, the method can further comprise the step of testing the library to determine if a particular modified small molecule which exhibits a desired activity is present within the library. The step of testing the library can further comprise the steps of systematically eliminating all but one of the biocatalytic reactions used to produce a portion of the plurality of the modified small molecules within the library by testing the portion of the modified small molecule for the presence or absence of the particular modified small molecule with a desired activity, and identifying at least one specific biocatalytic reaction that produces the particular modified small molecule of desired activity.

The invention provides methods for determining a functional fragment of a protease enzyme comprising the steps of: (a) providing a protease enzyme, wherein the enzyme comprises a polypeptide of the invention, or a polypeptide encoded by a nucleic acid of the invention, or a subsequence thereof; and (b) deleting a plurality of amino acid residues from the sequence of step (a) and testing the remaining subsequence for a protease activity, thereby determining a functional fragment of a protease enzyme. In one aspect, the protease activity is measured by providing a protease substrate and detecting a decrease in the amount of the substrate or an increase in the amount of a reaction product.

The invention provides methods for whole cell engineering of new or modified phenotypes by using real-time metabolic flux analysis, the method comprising the following steps: (a) making a modified cell by modifying the genetic composition of a cell, wherein the genetic composition is modified by addition to the cell of a nucleic acid of the invention; (b) culturing the modified cell to generate a plurality of modified cells; (c) measuring at least one metabolic parameter of the cell by monitoring the cell culture of step (b) in real time; and, (d) analyzing the data of step (c) to determine if the measured parameter differs from a comparable measurement in an unmodified cell under similar conditions, thereby identifying an engineered phenotype in the cell using real-time metabolic flux analysis. In one aspect, the genetic composition of the cell can be modified by a method comprising deletion of a sequence or modification of a sequence in the cell, or, knocking out the expression of a gene. In one aspect, the method can further comprise selecting a cell comprising a newly engineered phenotype. In another aspect, the method can comprise culturing the selected cell, thereby generating a new cell strain comprising a newly engineered phenotype.

The invention provides methods of increasing thermotolerance or thermostability of a protease polypeptide, the method comprising glycosylating a protease polypeptide, wherein the polypeptide comprises at least thirty contiguous amino acids of a polypeptide of the invention; or a polypeptide encoded by a nucleic acid sequence of the invention, thereby increasing the thermotolerance or thermostability of the protease polypeptide. In one aspect, the protease specific activity can be thermostable or thermotolerant at a temperature in the range from greater than about 37° C. to about 95° C.

The invention provides methods for overexpressing a recombinant protease polypeptide in a cell comprising expressing a vector comprising a nucleic acid comprising a nucleic acid of the invention or a nucleic acid sequence of the invention, wherein the sequence identities are determined by analysis with a sequence comparison algorithm or by visual inspection, wherein overexpression is effected by use of a high activity promoter, a dicistronic vector or by gene amplification of the vector.

The invention provides methods of making a transgenic plant comprising the following steps: (a) introducing a heterologous nucleic acid sequence into the cell, wherein the heterologous nucleic sequence comprises a nucleic acid sequence of the invention, thereby producing a transformed plant cell; and (b) producing a transgenic plant from the transformed cell. In one aspect, the step (a) can further comprise introducing the heterologous nucleic acid sequence by electroporation or microinjection of plant cell protoplasts. In another aspect, the step (a) can further comprise introducing the heterologous nucleic acid sequence directly to plant tissue by DNA particle bombardment. Alternatively, the step (a) can further comprise introducing the heterologous nucleic acid sequence into the plant cell DNA using an *Agrobacterium tumefaciens* host. In one aspect, the plant cell can be a potato, corn, rice, wheat, tobacco, or barley cell.

The invention provides methods of expressing a heterologous nucleic acid sequence in a plant cell comprising the following steps: (a) transforming the plant cell with a heterologous nucleic acid sequence operably linked to a promoter, wherein the heterologous nucleic sequence comprises a nucleic acid of the invention; (b) growing the plant under conditions wherein the heterologous nucleic acids sequence is expressed in the plant cell. The invention provides methods of expressing a heterologous nucleic acid sequence in a plant cell comprising the following steps: (a) transforming the plant cell with a heterologous nucleic acid sequence operably linked to a promoter, wherein the heterologous nucleic sequence comprises a sequence of the invention; (b) growing the plant under conditions wherein the heterologous nucleic acids sequence is expressed in the plant cell.

The invention provides methods for hydrolyzing, breaking up or disrupting a protein-comprising composition comprising the following steps: (a) providing a polypeptide of the invention having a protease activity, or a polypeptide encoded by a nucleic acid of the invention; (b) providing a composition comprising a protein; and (c) contacting the polypeptide of step (a) with the composition of step (b) under conditions wherein the protease hydrolyzes, breaks up or disrupts the protein-comprising composition. In one aspect, the composition comprises a plant cell, a bacterial cell, a yeast cell, an insect cell, or an animal cell. Thus, the composition can comprise any plant or plant part, any protein-containing food or feed, a waste product and the like. The invention provides methods for liquefying or removing a protein from a composition comprising the following steps: (a) providing a polypeptide of the invention having a protease activity, or a polypeptide encoded by a nucleic acid of the invention; (b) providing a composition comprising a protein; and (c) contacting the polypeptide of step (a) with the composition of step (b) under conditions wherein the protease removes or liquefies the protein.

The invention provides detergent compositions comprising a polypeptide of the invention, or a polypeptide encoded by a nucleic acid of the invention, wherein the polypeptide has a protease activity. The protease can be a nonsurface-active protease or a surface-active protease. The protease can be formulated in a non-aqueous liquid composition, a cast solid, a granular form, a particulate form, a compressed tablet, a gel form, a paste or a slurry form. The invention provides methods for washing an object comprising the following steps: (a) providing a composition comprising a polypeptide of the invention having a protease activity, or a polypeptide encoded by a nucleic acid of the invention; (b) providing an object; and (c) contacting the polypeptide of step (a) and the object of step (b) under conditions wherein the composition can wash the object.

The invention provides textiles or fabrics, including, e.g., threads, comprising a polypeptide of the invention, or a polypeptide encoded by a nucleic acid of the invention. In one aspect, the textiles or fabrics comprise cellulose-containing fibers. The invention provides methods for removing protein stains from a composition comprising the following steps: (a) providing a composition comprising a polypeptide of the invention having a protease activity, or a polypeptide encoded by a nucleic acid of the invention; (b) providing a composition having a protein stain; and (c) contacting the polypeptide of step (a) and the composition of step (b) under conditions wherein the protease can remove the stain. The invention provides methods for improving the finish of a fabric comprising the following steps: (a) providing a composition comprising a polypeptide of the invention having a protease activity, or a polypeptide encoded by a nucleic acid of the invention; (b) providing a fabric; and (c) contacting the polypeptide of step (a) and the fabric of step (b) under conditions wherein the polypeptide can treat the fabric thereby improving the finish of the fabric. In one aspect, the fabric is a wool or a silk.

The invention provides feeds or foods comprising a polypeptide of the invention, or a polypeptide encoded by a nucleic acid of the invention. The invention provides methods for hydrolyzing proteins in a feed or a food prior to consumption by an animal comprising the following steps: (a) obtaining a feed material comprising a protease of the invention, or a protease encoded by a nucleic acid of the invention; and (b) adding the polypeptide of step (a) to the feed or food material in an amount sufficient for a sufficient time period to cause hydrolysis of the protein and formation of a treated food or feed, thereby hydrolyzing the proteins in the food or the feed prior to consumption by the animal. In one aspect, the invention provides methods for hydrolyzing proteins in a feed or a food after consumption by an animal comprising the following steps: (a) obtaining a feed material comprising a protease of the invention, or a protease encoded by a nucleic acid of the invention; (b) adding the polypeptide of step (a) to the feed or food material; and (c) administering the feed or food material to the animal, wherein after consumption, the protease causes hydrolysis of the proteins in the feed or food in the digestive tract of the animal. The food or the feed can be, e.g., corn.

The invention provides methods for improving texture and flavor of a dairy product comprising the following steps: (a) providing a polypeptide of the invention having a protease activity, or a protease encoded by a nucleic acid of the invention; (b) providing a dairy product; and (c) contacting the polypeptide of step (a) and the dairy product of step (b) under conditions wherein the protease can improve the texture or flavor of the dairy product. In one aspect, the dairy product comprises a cheese or a yogurt. The invention provides dairy products comprising a protease of the invention, or is encoded by a nucleic acid of the invention. The invention provides methods for tenderizing a meat or a fish comprising the following steps: (a) providing a polypeptide of the invention having a protease activity, or a protease encoded by a nucleic acid of the invention; (b) providing a composition comprising meat or fish; and (c) contacting the polypeptide of step (a) and the composition of step (b) under conditions wherein the polypeptide can tenderize the meat or the fish. The invention provides methods for producing a gluten-free product comprising the following steps: (a) providing a polypeptide of the invention having a protease activity, or a protease encoded by a nucleic acid of the invention; (b) providing a product comprising gluten; and (c) contacting the polypeptide of step (a) and the product of step (b) under conditions wherein the polypeptide can hydrolyze gluten thereby producing the gluten-free product. In one aspect, the gluten-free product is a cereal, a bread or a beer. The invention provides gluten-free food compositions comprising a polypeptide of the invention, or a protease encoded by a nucleic acid of the invention, wherein the polypeptide comprises a protease activity.

The invention provides methods for improving the extraction of oil from an oil-rich plant material comprising the following steps: (a) providing a polypeptide of the invention having a protease activity, or a protease encoded by a nucleic acid of the invention; (b) providing an oil-rich plant material; and (c) contacting the polypeptide of step (a) and the oil-rich plant material. In one aspect, the oil-rich plant material comprises an oil-rich seed. The oil can be a soybean oil, an olive oil, a rapeseed (canola) oil or a sunflower oil.

The invention provides methods for preparing a fruit or vegetable juice, syrup, puree or extract comprising the following steps: (a) providing a polypeptide of the invention having a protease activity, or a protease encoded by a nucleic acid of the invention; (b) providing a composition or a liquid comprising a fruit or vegetable material; and (c) contacting the polypeptide of step (a) and the composition, thereby preparing the fruit or vegetable juice, syrup, puree or extract.

The invention provides papers or paper products or paper pulp comprising a protease of the invention, or a polypeptide encoded by a nucleic acid of the invention. The invention provides methods for treating a paper or a paper or wood pulp comprising the following steps: (a) providing a polypeptide of the invention having a protease activity, or a protease encoded by a nucleic acid of the invention; (b) providing a composition comprising a paper or a paper or wood pulp; and (c) contacting the polypeptide of step (a) and the composition of step (b) under conditions wherein the protease can treat the paper or paper or wood pulp.

The invention provides pharmaceutical compositions comprising a polypeptide of the invention, or a polypeptide encoded by a nucleic acid of the invention. In one aspect, the pharmaceutical composition acts as a digestive aid or as a topical skin care. The invention provides methods of treating an imbalance of desquamation comprising topical application of a pharmaceutical composition of the invention. In one aspect, the treatment is prophylactic. The invention provides oral care products comprising a polypeptide of the invention having a protease activity, or a protease encoded by a nucleic acid of the invention. The oral care product can comprise a toothpaste, a dental cream, a gel or a tooth powder, an odontic, a mouth wash, a pre- or post brushing rinse formulation, a chewing gum, a lozenge or a candy. The invention provides contact lens cleaning compositions comprising a polypeptide of the invention having a protease activity, or a protease encoded by a nucleic acid of the invention.

The invention provides methods for treating solid or liquid animal waste products comprising the following steps: (a) providing a polypeptide of the invention having a protease activity, or a protease encoded by a nucleic acid of the invention; (b) providing a solid or a liquid animal waste; and (c) contacting the polypeptide of step (a) and the solid or liquid waste of step (b) under conditions wherein the protease can treat the waste. The invention provides processed waste products comprising a polypeptide of the invention having a protease activity, or a protease encoded by a nucleic acid of the invention.

The invention provides hairball prevention and/or remedies comprising a polypeptide of the invention having a protease activity, or a protease encoded by a nucleic acid of the invention. The invention provides blood or organic spot removers comprising a polypeptide of the invention having a protease activity, or a protease encoded by a nucleic acid of the invention.

The details of one or more embodiments of the invention are set forth in the accompanying drawings and the description below. Other features, objects, and advantages of the invention will be apparent from the description and drawings, and from the claims.

All publications, patents, patent applications, GenBank sequences and ATCC deposits, cited herein are hereby expressly incorporated by reference for all purposes.

DESCRIPTION OF DRAWINGS

The patent or application file contains at least one drawing executed in color. Copies of this patent or patent application publication with color drawing(s) will be provided by the Office upon request and payment of the necessary fee.

Like reference symbols in the various drawings indicate like elements.

DETAILED DESCRIPTION

Figure 1:
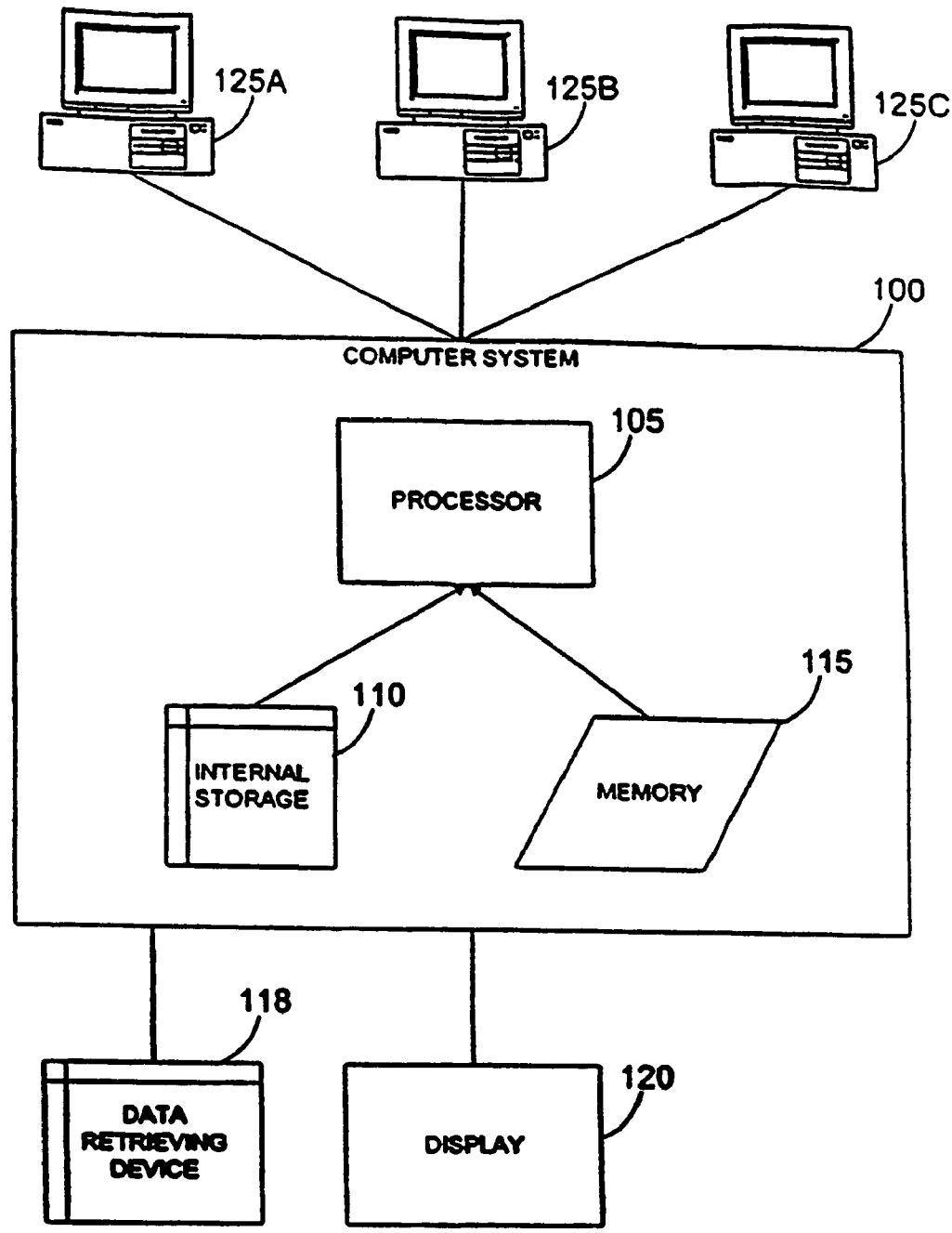
FIG. 1 is a block diagram of a computer system.

The invention provides polypeptides having a protease activity, polynucleotides encoding the polypeptides, and methods for making and using these polynucleotides and polypeptides. In one aspect, the proteases of the invention are used to catalyze the hydrolysis of peptide bonds. The proteases of the invention can be used to make and/or process foods or feeds, textiles, detergents and the like. The proteases of the invention can be used in pharmaceutical compositions and dietary aids.

The protease preparations of the invention (including those for treating or processing feeds or foods, treating fibers and textiles, waste treatments, plant treatments, and the like) can further comprise one or more enzymes, for example, pectate lyases, cellulases (endo-beta-1,4-glucanases), beta-glucanases (endo-beta-1,3(4)-glucanases), lipases, cutinases, peroxidases, laccases, amylases, glucoamylases, pectinases, reductases, oxidases, phenoloxidases, ligninases, pullulanases, arabinanases, hemicellulases, mannanases, xyloglucanases, xylanases, pectin acetyl esterases, rhamnogalacturonan acetyl esterases, polygalacturonases, rhamnogalacturonases, galactanases, pectin lyases, pectin methylesterases, cellobiohydrolases, transglutaminases; or mixtures thereof.

DEFINITIONS

The term "protease" includes all polypeptides having a protease activity, including a peptidase and/or a proteinase activity. A protease activity of the invention can comprise catalysis of the hydrolysis of peptide bonds. The proteases of the invention can catalyze peptide hydrolysis reactions in both directions. The direction of the reaction can be determined, e.g., by manipulating substrate and/or product concentrations, temperature, selection of protease and the like. The protease activity can comprise an endoprotease activity and/or an exoprotease activity. The protease activity can comprise a protease activity, e.g., a carboxypeptidase activity, a dipeptidylpeptidase or an aminopeptidase activity, a serine protease activity, a metalloproteinase activity, a cysteine protease activity and/or an aspartic protease activity. In one aspect, protease activity can comprise activity the same or similar to a chymotrypsin, a trypsin, an elastase, a kallikrein and/or a subtilisin activity.

In describing a polypeptide of the invention having a protease activity, e.g., an exemplary polypeptide having a sequence as set forth in SEQ ID NO:2; SEQ ID NO:4; SEQ ID NO:6; SEQ ID NO:8; SEQ ID NO:10; SEQ ID NO:12; SEQ ID NO:14; SEQ ID NO:16; SEQ ID NO:18; SEQ ID NO:20; SEQ ID NO:22; SEQ ID NO:24; SEQ ID NO:26; SEQ ID NO:28; SEQ ID NO:30; SEQ ID NO:32; SEQ ID NO:34; SEQ ID NO:36; SEQ ID NO:38; SEQ ID NO:40; SEQ ID NO:42; SEQ ID NO:44; SEQ ID NO:46; SEQ ID NO:48; SEQ ID NO:50; SEQ ID NO:52; SEQ ID NO:54; SEQ ID NO:56; SEQ ID NO:58; SEQ ID NO:60; SEQ ID NO:62; SEQ ID NO:64; SEQ ID NO:66; SEQ ID NO:68; SEQ ID NO:70; SEQ ID NO:72; SEQ ID NO:74; SEQ ID NO:76;

SEQ ID NO:78; SEQ ID NO:80; SEQ ID NO:82; SEQ ID NO:84; SEQ ID NO:86; SEQ ID NO:88; SEQ ID NO:90; SEQ ID NO:92; SEQ ID NO:94; SEQ ID NO:96; SEQ ID NO:98; SEQ ID NO:100; SEQ ID NO:102; SEQ ID NO:104; SEQ ID NO:106; SEQ ID NO:108; SEQ ID NO:110; SEQ ID NO:112; SEQ ID NO:114; SEQ ID NO:116; SEQ ID NO:118; SEQ ID NO:120; SEQ ID NO:122; SEQ ID NO:124; SEQ ID NO:126; SEQ ID NO:128; SEQ ID NO:130; SEQ ID NO:132; SEQ ID NO:134; SEQ ID NO:136; SEQ ID NO:138; SEQ ID NO:140; SEQ ID NO:142; SEQ ID NO:144; SEQ ID NO:147; SEQ ID NO:151; SEQ ID NO:159; SEQ ID NO:165; SEQ ID NO:172; SEQ ID NO:180; SEQ ID NO:188; SEQ ID NO:194; SEQ ID NO:200; SEQ ID NO:205; SEQ ID NO:211; SEQ ID NO:219; SEQ ID NO:223; SEQ ID NO:230; SEQ ID NO:235; SEQ ID NO:242; SEQ ID NO:249; SEQ ID NO:255; a polypeptide encoded by SEQ ID NO:145, it is meant that the polypeptide has a protease activity with and/or without a signal sequence, or, with and/or without a prepro sequence (e.g., a "prepro" domain), if the polypeptide has a signal sequence and/or a prepro sequence (e.g., a "prepro" domain). Thus, the invention includes polypeptides (having a protease activity) in inactive form, e.g., as a proprotein before "maturation" or processing of its prepro sequence (e.g., by a proprotein-processing enzyme, such as a proprotein convertase) to generate an "active" mature protein, or, before "activation" by a post-translational processing event, e.g., an endo- or exo-peptidase or proteinase action, a phosphorylation event, an amidation, a glycosylation or a sulfation, a dimerization event, and the like, in addition to including all active forms and active subsequences (e.g., catalytic domains or active sites) of the protease.

A polypeptide can be routinely assayed for protease activity (e.g., tested to see if the protein is within the scope of the invention) by any method, e.g., protease activity can be assayed by the hydrolysis of casein in zymograms, the release of fluorescence from gelatin, or the release of p-nitroanalide from various small peptide substrates (these and other exemplary protease assays are set forth in the Examples, below).

The term "antibody" includes a peptide or polypeptide derived from, modeled after or substantially encoded by an immunoglobulin gene or immunoglobulin genes, or fragments thereof, capable of specifically binding an antigen or epitope, see, e.g. Fundamental Immunology, Third Edition, W. E. Paul, ed., Raven Press, N.Y. (1993); Wilson (1994) J. Immunol. Methods 175:267-273; Yarmush (1992) J. Biochem. Biophys. Methods 25:85-97. The term antibody includes antigen-binding portions, i.e., "antigen binding sites," (e.g., fragments, subsequences, complementarity determining regions (CDRs)) that retain capacity to bind antigen, including (i) a Fab fragment, a monovalent fragment consisting of the VL, VH, CL and CH1 domains; (ii) a F(ab')2 fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., (1989) Nature 341:544-546), which consists of a VH domain; and (vi) an isolated complementarity determining region (CDR). Single chain antibodies are also included by reference in the term "antibody."

The terms "array" or "microarray" or "biochip" or "chip" as used herein is a plurality of target elements, each target element comprising a defined amount of one or more polypeptides (including antibodies) or nucleic acids immobilized onto a defined area of a substrate surface, as discussed in further detail, below.

As used herein, the terms "computer," "computer program" and "processor" are used in their broadest general contexts and incorporate all such devices, as described in detail, below. A "coding sequence of" or a "sequence encodes" a particular polypeptide or protein, is a nucleic acid sequence which is transcribed and translated into a polypeptide or protein when placed under the control of appropriate regulatory sequences.

The term "expression cassette" as used herein refers to a nucleotide sequence which is capable of affecting expression of a structural gene (i.e., a protein coding sequence, such as a protease of the invention) in a host compatible with such sequences. Expression cassettes include at least a promoter operably linked with the polypeptide coding sequence; and, optionally, with other sequences, e.g., transcription termination signals. Additional factors necessary or helpful in effecting expression may also be used, e.g., enhancers. Thus, expression cassettes also include plasmids, expression vectors, recombinant viruses, any form of recombinant "naked DNA" vector, and the like.

"Operably linked" as used herein refers to a functional relationship between two or more nucleic acid (e.g., DNA) segments. Typically, it refers to the functional relationship of transcriptional regulatory sequence to a transcribed sequence. For example, a promoter is operably linked to a coding sequence, such as a nucleic acid of the invention, if it stimulates or modulates the transcription of the coding sequence in an appropriate host cell or other expression system. Generally, promoter transcriptional regulatory sequences that are operably linked to a transcribed sequence are physically contiguous to the transcribed sequence, i.e., they are cis-acting. However, some transcriptional regulatory sequences, such as enhancers, need not be physically contiguous or located in close proximity to the coding sequences whose transcription they enhance.

A "vector" comprises a nucleic acid which can infect, transfect, transiently or permanently transduce a cell. It will be recognized that a vector can be a naked nucleic acid, or a nucleic acid complexed with protein or lipid. The vector optionally comprises viral or bacterial nucleic acids and/or proteins, and/or membranes (e.g., a cell membrane, a viral lipid envelope, etc.). Vectors include, but are not limited to replicons (e.g., RNA replicons, bacteriophages) to which fragments of DNA may be attached and become replicated. Vectors thus include, but are not limited to RNA, autonomous self-replicating circular or linear DNA or RNA (e.g., plasmids, viruses, and the like, see, e.g., U.S. Pat. No. 5,217,879), and include both the expression and non-expression plasmids. Where a recombinant microorganism or cell culture is described as hosting an "expression vector" this includes both extra-chromosomal circular and linear DNA and DNA that has been incorporated into the host chromosome(s). Where a vector is being maintained by a host cell, the vector may either be stably replicated by the cells during mitosis as an autonomous structure, or is incorporated within the host's genome.

As used herein, the term "promoter" includes all sequences capable of driving transcription of a coding sequence in a cell, e.g., a plant cell. Thus, promoters used in the constructs of the invention include cis-acting transcriptional control elements and regulatory sequences that are involved in regulating or modulating the timing and/or rate of transcription of a gene. For example, a promoter can be a cis-acting transcriptional control element, including an enhancer, a promoter, a transcription terminator, an origin of replication, a chromosomal integration sequence, 5' and 3' untranslated regions, or an intronic sequence, which are involved in transcriptional regulation. These cis-acting sequences typically interact with proteins or other biomolecules to carry out (turn on/off, regulate, modulate, etc.) transcription. "Constitutive" promoters are those that drive expression continuously under most environmental conditions and states of development or cell differentiation. "Inducible" or "regulatable" promoters direct expression of the nucleic acid of the invention under the influence of environmental conditions or developmental conditions. Examples of environmental conditions that may affect transcription by inducible promoters include anaerobic conditions, elevated temperature, drought, or the presence of light.

"Tissue-specific" promoters are transcriptional control elements that are only active in particular cells or tissues or organs, e.g., in plants or animals. Tissue-specific regulation may be achieved by certain intrinsic factors which ensure that genes encoding proteins specific to a given tissue are expressed. Such factors are known to exist in mammals and plants so as to allow for specific tissues to develop.

The term "plant" includes whole plants, plant parts (e.g., leaves, stems, flowers, roots, etc.), plant protoplasts, seeds and plant cells and progeny of same. The class of plants which can be used in the method of the invention is generally as broad as the class of higher plants amenable to transformation techniques, including angiosperms (monocotyledonous and dicotyledonous plants), as well as gymnosperms. It includes plants of a variety of ploidy levels, including polyploid, diploid, haploid and hemizygous states. As used herein, the term "transgenic plant" includes plants or plant cells into which a heterologous nucleic acid sequence has been inserted, e.g., the nucleic acids and various recombinant constructs (e.g., expression cassettes) of the invention.

"Plasmids" can be commercially available, publicly available on an unrestricted basis, or can be constructed from available plasmids in accord with published procedures. Equivalent plasmids to those described herein are known in the art and will be apparent to the ordinarily skilled artisan The term "gene" includes a nucleic acid sequence comprising a segment of DNA involved in producing a transcription product (e.g., a message), which in turn is translated to produce a polypeptide chain, or regulates gene transcription, reproduction or stability. Genes can include regions preceding and following the coding region, such as leader and trailer, promoters and enhancers, as well as, where applicable, intervening sequences (introns) between individual coding segments (exons).

The phrases "nucleic acid" or "nucleic acid sequence" includes oligonucleotide, nucleotide, polynucleotide, or to a fragment of any of these, to DNA or RNA (e.g., mRNA, rRNA, tRNA, iRNA) of genomic or synthetic origin which may be single-stranded or double-stranded and may represent a sense or antisense strand, to peptide nucleic acid (PNA), or to any DNA-like or RNA-like material, natural or synthetic in origin, including, e.g., iRNA, ribonucleoproteins (e.g., e.g., double stranded iRNAs, e.g., iRNPs). The term encompasses nucleic acids, i.e., oligonucleotides, containing known analogues of natural nucleotides. The term also encompasses nucleic-acid-like structures with synthetic backbones, see e.g., Mata (1997) Toxicol. Appl. Pharmacol. 144:189-197; Strauss-Soukup (1997) Biochemistry 36:8692-8698; Samstag (1996) Antisense Nucleic Acid Drug Dev 6:153-156.

"Amino acid" or "amino acid sequence" include an oligopeptide, peptide, polypeptide, or protein sequence, or to a fragment, portion, or subunit of any of these, and to naturally occurring or synthetic molecules. The terms "polypeptide" and "protein" include amino acids joined to each other by peptide bonds or modified peptide bonds, i.e., peptide isosteres, and may contain modified amino acids other than the 20 gene-encoded amino acids. The term "polypeptide" also includes peptides and polypeptide fragments, motifs and the like. The term also includes glycosylated polypeptides. The peptides and polypeptides of the invention also include all "mimetic" and "peptidomimetic" forms, as described in further detail, below.

The term "isolated" includes a material removed from its original environment, e.g., the natural environment if it is naturally occurring. For example, a naturally occurring polynucleotide or polypeptide present in a living animal is not isolated, but the same polynucleotide or polypeptide, separated from some or all of the coexisting materials in the natural system, is isolated. Such polynucleotides could be part of a vector and/or such polynucleotides or polypeptides could be part of a composition, and still be isolated in that such vector or composition is not part of its natural environment. As used herein, an isolated material or composition can also be a "purified" composition, i.e., it does not require absolute purity; rather, it is intended as a relative definition. Individual nucleic acids obtained from a library can be conventionally purified to electrophoretic homogeneity. In alternative aspects, the invention provides nucleic acids which have been purified from genomic DNA or from other sequences in a library or other environment by at least one, two, three, four, five or more orders of magnitude.

As used herein, the term "recombinant" can include nucleic acids adjacent to a "backbone" nucleic acid to which it is not adjacent in its natural environment. In one aspect, nucleic acids represent 5% or more of the number of nucleic acid inserts in a population of nucleic acid "backbone molecules." "Backbone molecules" according to the invention include nucleic acids such as expression vectors, self-replicating nucleic acids, viruses, integrating nucleic acids, and other vectors or nucleic acids used to maintain or manipulate a nucleic acid insert of interest. In one aspect, the enriched nucleic acids represent 10%, 15%, 20%, 30%, 40%, 50%, 60%, 70%, 80%, 90%, 95%, 98% or more of the number of nucleic acid inserts in the population of recombinant backbone molecules. "Recombinant" polypeptides or proteins refer to polypeptides or proteins produced by recombinant DNA techniques; e.g., produced from cells transformed by an exogenous DNA construct encoding the desired polypeptide or protein. "Synthetic" polypeptides or protein are those prepared by chemical synthesis, as described in further detail, below.

A promoter sequence can be "operably linked to" a coding sequence when RNA polymerase which initiates transcription at the promoter will transcribe the coding sequence into mRNA, as discussed further, below.

"Oligonucleotide" includes either a single stranded polydeoxynucleotide or two complementary polydeoxynucleotide strands which may be chemically synthesized. Such synthetic oligonucleotides have no 5' phosphate and thus will not ligate to another oligonucleotide without adding a phosphate with an ATP in the presence of a kinase. A synthetic oligonucleotide can ligate to a fragment that has not been dephosphorylated.

The phrase "substantially identical" in the context of two nucleic acids or polypeptides, can refer to two or more sequences that have, e.g., at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more nucleotide or amino acid residue (sequence) identity, when compared and aligned for maximum correspondence, as measured using one any known sequence comparison algorithm, as discussed in detail below, or by visual inspection. In alternative aspects, the invention provides nucleic acid and polypeptide sequences having substantial identity to an exemplary sequence of the invention, e.g., SEQ ID NO:1; SEQ ID NO:3; SEQ ID NO:5; SEQ ID NO:7; SEQ ID NO:9; SEQ ID NO:11; SEQ ID NO:13; SEQ ID NO:15; SEQ ID NO:17; SEQ ID NO:19; SEQ ID NO:21; SEQ ID NO:23; SEQ ID NO:25; SEQ ID NO:27; SEQ ID NO:29; SEQ ID NO:31; SEQ ID NO:33; SEQ ID NO:35; SEQ ID NO:37; SEQ ID NO:39; SEQ ID NO:41; SEQ ID NO:43; SEQ ID NO:45; SEQ ID NO:47; SEQ ID NO:49; SEQ ID NO:51; SEQ ID NO:53; SEQ ID NO:55; SEQ ID NO:57; SEQ ID NO:59; SEQ ID NO:61; SEQ ID NO:63; SEQ ID NO:65; SEQ ID NO:67; SEQ ID NO:69; SEQ ID NO:71; SEQ ID NO:73; SEQ ID NO:75; SEQ ID NO:77; SEQ ID NO:79; SEQ ID NO:81; SEQ ID NO:83; SEQ ID NO:85; SEQ ID NO:87; SEQ ID NO:89; SEQ ID NO:91; SEQ ID NO:93; SEQ ID NO:95; SEQ ID NO:97; SEQ ID NO:99; SEQ ID NO:101; SEQ ID NO:103; SEQ ID NO:105; SEQ ID NO:107; SEQ ID NO:109; SEQ ID NO:111; SEQ ID NO:113; SEQ ID NO:115; SEQ ID NO:117; SEQ ID NO:119; SEQ ID NO:121; SEQ ID NO:123; SEQ ID NO:125; SEQ ID NO:127; SEQ ID NO:129; SEQ ID NO:131; SEQ ID NO:133; SEQ ID NO:135; SEQ ID NO:137; SEQ ID NO:139; SEQ ID NO:141; SEQ ID NO:143; SEQ ID NO:145; SEQ ID NO:146; SEQ ID NO:150; SEQ ID NO:158; SEQ ID NO:164; SEQ ID NO:171; SEQ ID NO:179; SEQ ID NO:187; SEQ ID NO:193; SEQ ID NO:199; SEQ ID NO:204; SEQ ID NO:210; SEQ ID NO:218; SEQ ID NO:222; SEQ ID NO:229; SEQ ID NO:234; SEQ ID NO:241; SEQ ID NO:248 and/or SEQ ID NO:254 (nucleic acids); SEQ ID NO:2; SEQ ID NO:4; SEQ ID NO:6; SEQ ID NO:8; SEQ ID NO:10; SEQ ID NO:12; SEQ ID NO:14; SEQ ID NO:16; SEQ ID NO:18; SEQ ID NO:20; SEQ ID NO:22; SEQ ID NO:24; SEQ ID NO:26; SEQ ID NO:28; SEQ ID NO:30; SEQ ID NO:32; SEQ ID NO:34; SEQ ID NO:36; SEQ ID NO:38; SEQ ID NO:40; SEQ ID NO:42; SEQ ID NO:44; SEQ ID NO:46; SEQ ID NO:48; SEQ ID NO:50; SEQ ID NO:52; SEQ ID NO:54; SEQ ID NO:56; SEQ ID NO:58; SEQ ID NO:60; SEQ ID NO:62; SEQ ID NO:64; SEQ ID NO:66; SEQ ID NO:68; SEQ ID NO:70; SEQ ID NO:72; SEQ ID NO:74; SEQ ID NO:76; SEQ ID NO:78; SEQ ID NO:80; SEQ ID NO:82; SEQ ID NO:84; SEQ ID NO:86; SEQ ID NO:88; SEQ ID NO:90; SEQ ID NO:92; SEQ ID NO:94; SEQ ID NO:96; SEQ ID NO:98; SEQ ID NO:100; SEQ ID NO:102; SEQ ID NO:104; SEQ ID NO:106; SEQ ID NO:108; SEQ ID NO:110; SEQ ID NO:112; SEQ ID NO:114; SEQ ID NO:116; SEQ ID NO:118; SEQ ID NO:120; SEQ ID NO:122; SEQ ID NO:124; SEQ ID NO:126; SEQ ID NO:128; SEQ ID NO:130; SEQ ID NO:132; SEQ ID NO:134; SEQ ID NO:136; SEQ ID NO:138; SEQ ID NO:140; SEQ ID NO:142; SEQ ID NO:144; SEQ ID NO:147; SEQ ID NO:151; SEQ ID NO:159; SEQ ID NO:165; SEQ ID NO:172; SEQ ID NO:180; SEQ ID NO:188; SEQ ID NO:194; SEQ ID NO:200; SEQ ID NO:205; SEQ ID NO:211; SEQ ID NO:219; SEQ ID NO:223; SEQ ID NO:230; SEQ ID NO:235; SEQ ID NO:242; SEQ ID NO:249 or SEQ ID NO:255, or the polypeptide encoded by SEQ ID NO:145, over a region of at least about 10, 20, 30, 40, 50, 100, 150, 200, 250, 300, 350, 400, 450, 500, 550, 600, 650, 700, 750, 800, 850, 900, 950, 1000 or more residues, or a region ranging from between about 50 residues to the full length of the nucleic acid or polypeptide. Nucleic acid sequences of the invention can be substantially identical over the entire length of a polypeptide coding region.

A "substantially identical" amino acid sequence also can include a sequence that differs from a reference sequence by one or more conservative or non-conservative amino acid substitutions, deletions, or insertions, particularly when such a substitution occurs at a site that is not the active site of the molecule, and provided that the polypeptide essentially retains its functional properties. A conservative amino acid substitution, for example, substitutes one amino acid for another of the same class (e.g., substitution of one hydrophobic amino acid, such as isoleucine, valine, leucine, or methionine, for another, or substitution of one polar amino acid for another, such as substitution of arginine for lysine, glutamic acid for aspartic acid or glutamine for asparagine). One or more amino acids can be deleted, for example, from a protease, resulting in modification of the structure of the polypeptide, without significantly altering its biological activity. For example, amino- or carboxyl-terminal amino acids that are not required for protease activity can be removed.

"Hybridization" includes the process by which a nucleic acid strand joins with a complementary strand through base pairing. Hybridization reactions can be sensitive and selective so that a particular sequence of interest can be identified even in samples in which it is present at low concentrations. Stringent conditions can be defined by, for example, the concentrations of salt or formamide in the prehybridization and hybridization solutions, or by the hybridization temperature, and are well known in the art. For example, stringency can be increased by reducing the concentration of salt, increasing the concentration of formamide, or raising the hybridization temperature, altering the time of hybridization, as described in detail, below. In alternative aspects, nucleic acids of the invention are defined by their ability to hybridize under various stringency conditions (e.g., high, medium, and low), as set forth herein.

"Variant" includes polynucleotides or polypeptides of the invention modified at one or more base pairs, codons, introns, exons, or amino acid residues (respectively) yet still retain the biological activity of a protease of the invention (which can be assayed by, e.g., the hydrolysis of casein in zymograms, the release of fluorescence from gelatin, or the release of p-nitroanalide from various small peptide substrates). Variants can be produced by any number of means included methods such as, for example, error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, GSSM and any combination thereof. Techniques for producing variant protease having activity at a pH or temperature, for example, that is different from a wild-type protease, are included herein.

The term "saturation mutagenesis" or "GSSM" includes a method that uses degenerate oligonucleotide primers to introduce point mutations into a polynucleotide, as described in detail, below.

The term "optimized directed evolution system" or "optimized directed evolution" includes a method for reassembling fragments of related nucleic acid sequences, e.g., related genes, and explained in detail, below.

The term "synthetic ligation reassembly" or "SLR" includes a method of ligating oligonucleotide fragments in a non-stochastic fashion, and explained in detail, below.

Generating and Manipulating Nucleic Acids

The invention provides nucleic acids (e.g., SEQ ID NO:1; SEQ ID NO:3; SEQ ID NO:5; SEQ ID NO:7; SEQ ID NO:9;

SEQ ID NO:11; SEQ ID NO:13; SEQ ID NO:15; SEQ ID NO:17; SEQ ID NO:19; SEQ ID NO:21; SEQ ID NO:23; SEQ ID NO:25; SEQ ID NO:27; SEQ ID NO:29; SEQ ID NO:31; SEQ ID NO:33; SEQ ID NO:35; SEQ ID NO:37; SEQ ID NO:39; SEQ ID NO:41; SEQ ID NO:43; SEQ ID NO:45; SEQ ID NO:47; SEQ ID NO:49; SEQ ID NO:51; SEQ ID NO:53; SEQ ID NO:55; SEQ ID NO:57; SEQ ID NO:59; SEQ ID NO:61; SEQ ID NO:63; SEQ ID NO:65; SEQ ID NO:67; SEQ ID NO:69; SEQ ID NO:71; SEQ ID NO:73; SEQ ID NO:75; SEQ ID NO:77; SEQ ID NO:79; SEQ ID NO:81; SEQ ID NO:83; SEQ ID NO:85; SEQ ID NO:87; SEQ ID NO:89; SEQ ID NO:91; SEQ ID NO:93; SEQ ID NO:95; SEQ ID NO:97; SEQ ID NO:99; SEQ ID NO:101; SEQ ID NO:103; SEQ ID NO:105; SEQ ID NO:107; SEQ ID NO:109; SEQ ID NO:11; SEQ ID NO:113; SEQ ID NO:115; SEQ ID NO:117; SEQ ID NO:119; SEQ ID NO:121; SEQ ID NO:123; SEQ ID NO:125; SEQ ID NO:127; SEQ ID NO:129; SEQ ID NO:131; SEQ ID NO:133; SEQ ID NO:135; SEQ ID NO:137; SEQ ID NO:139; SEQ ID NO:141; SEQ ID NO:143; SEQ ID NO:145; SEQ ID NO:146; SEQ ID NO:150; SEQ ID NO:158; SEQ ID NO:164; SEQ ID NO:171; SEQ ID NO:179; SEQ ID NO:187; SEQ ID NO:193; SEQ ID NO:199; SEQ ID NO:204; SEQ ID NO:210; SEQ ID NO:218; SEQ ID NO:222; SEQ ID NO:229; SEQ ID NO:234; SEQ ID NO:241; SEQ ID NO:248 and/or SEQ ID NO:254; nucleic acids encoding polypeptides as set forth in SEQ ID NO:2; SEQ ID NO:4; SEQ ID NO:6; SEQ ID NO:8; SEQ ID NO:10; SEQ ID NO:12; SEQ ID NO:14; SEQ ID NO:16; SEQ ID NO:18; SEQ ID NO:20; SEQ ID NO:22; SEQ ID NO:24; SEQ ID NO:26; SEQ ID NO:28; SEQ ID NO:30; SEQ ID NO:32; SEQ ID NO:34; SEQ ID NO:36; SEQ ID NO:38; SEQ ID NO:40; SEQ ID NO:42; SEQ ID NO:44; SEQ ID NO:46; SEQ ID NO:48; SEQ ID NO:50; SEQ ID NO:52; SEQ ID NO:54; SEQ ID NO:56; SEQ ID NO:58; SEQ ID NO:60; SEQ ID NO:62; SEQ ID NO:64; SEQ ID NO:66; SEQ ID NO:68; SEQ ID NO:70; SEQ ID NO:72; SEQ ID NO:74; SEQ ID NO:76; SEQ ID NO:78; SEQ ID NO:80; SEQ ID NO:82; SEQ ID NO:84; SEQ ID NO:86; SEQ ID NO:88; SEQ ID NO:90; SEQ ID NO:92; SEQ ID NO:94; SEQ ID NO:96; SEQ ID NO:98; SEQ ID NO:100; SEQ ID NO:102; SEQ ID NO:104; SEQ ID NO:106; SEQ ID NO:108; SEQ ID NO:110; SEQ ID NO:112; SEQ ID NO:114; SEQ ID NO:116; SEQ ID NO:118; SEQ ID NO:120; SEQ ID NO:122; SEQ ID NO:124; SEQ ID NO:126; SEQ ID NO:128; SEQ ID NO:130; SEQ ID NO:132; SEQ ID NO:134; SEQ ID NO:136; SEQ ID NO:138; SEQ ID NO:140; SEQ ID NO:142; SEQ ID NO:144; SEQ ID NO:147; SEQ ID NO:151; SEQ ID NO:159; SEQ ID NO:165; SEQ ID NO:172; SEQ ID NO:180; SEQ ID NO:188; SEQ ID NO:194; SEQ ID NO:200; SEQ ID NO:205; SEQ ID NO:211; SEQ ID NO:219; SEQ ID NO:223; SEQ ID NO:230; SEQ ID NO:235; SEQ ID NO:242; SEQ ID NO:249 or SEQ ID NO:255, or the polypeptide encoded by SEQ ID NO:145, including expression cassettes such as expression vectors, encoding the polypeptides of the invention. The invention also includes methods for discovering new protease sequences using the nucleic acids of the invention. The invention also includes methods for inhibiting the expression of protease genes, transcripts and polypeptides using the nucleic acids of the invention. Also provided are methods for modifying the nucleic acids of the invention by, e.g., synthetic ligation reassembly, optimized directed evolution system and/or saturation mutagenesis.

The nucleic acids of the invention can be made, isolated and/or manipulated by, e.g., cloning and expression of cDNA libraries, amplification of message or genomic DNA by PCR, and the like. In practicing the methods of the invention, homologous genes can be modified by manipulating a template nucleic acid, as described herein. The invention can be practiced in conjunction with any method or protocol or device known in the art, which are well described in the scientific and patent literature.

General Techniques

The nucleic acids used to practice this invention, whether RNA, iRNA, antisense nucleic acid, cDNA, genomic DNA, vectors, viruses or hybrids thereof, may be isolated from a variety of sources, genetically engineered, amplified, and/or expressed/generated recombinantly. Recombinant polypeptides (e.g., proteases) generated from these nucleic acids can be individually isolated or cloned and tested for a desired activity. Any recombinant expression system can be used, including bacterial, mammalian, yeast, insect or plant cell expression systems.

Alternatively, these nucleic acids can be synthesized in vitro by well-known chemical synthesis techniques, as described in, e.g., Adams (1983) J. Am. Chem. Soc. 105:661; Belousov (1997) Nucleic Acids Res. 25:3440-3444; Frenkel (1995) Free Radic. Biol. Med. 19:373-380; Blommers (1994) Biochemistry 33:7886-7896; Narang (1979) Meth. Enzymol. 68:90; Brown (1979) Meth. Enzymol. 68:109; Beaucage (1981) Tetra. Lett. 22:1859; U.S. Pat. No. 4,458,066.

Techniques for the manipulation of nucleic acids, such as, e.g., subcloning, labeling probes (e.g., random-primer labeling using Klenow polymerase, nick translation, amplification), sequencing, hybridization and the like are well described in the scientific and patent literature, see, e.g., Sambrook, ed., MOLECULAR CLONING: A LABORATORY MANUAL (2ND ED.), Vols. 1-3, Cold Spring Harbor Laboratory, (1989); CURRENT PROTOCOLS IN MOLECULAR BIOLOGY, Ausubel, ed. John Wiley & Sons, Inc., New York (1997); LABORATORY TECHNIQUES IN BIOCHEMISTRY AND MOLECULAR BIOLOGY: HYBRIDIZATION WITH NUCLEIC ACID PROBES, Part I. Theory and Nucleic Acid Preparation, Tijssen, ed. Elsevier, N.Y. (1993).

Another useful means of obtaining and manipulating nucleic acids used to practice the methods of the invention is to clone from genomic samples, and, if desired, screen and re-clone inserts isolated or amplified from, e.g., genomic clones or cDNA clones. Sources of nucleic acid used in the methods of the invention include genomic or cDNA libraries contained in, e.g., mammalian artificial chromosomes (MACs), see, e.g., U.S. Pat. Nos. 5,721,118; 6,025,155; human artificial chromosomes, see, e.g., Rosenfeld (1997) Nat. Genet. 15:333-335; yeast artificial chromosomes (YAC); bacterial artificial chromosomes (BAC); P1 artificial chromosomes, see, e.g., Woon (1998) Genomics 50:306-316; P1-derived vectors (PACs), see, e.g., Kern (1997) Biotechniques 23:120-124; cosmids, recombinant viruses, phages or plasmids.

In one aspect, a nucleic acid encoding a polypeptide of the invention is assembled in appropriate phase with a leader sequence capable of directing secretion of the translated polypeptide or fragment thereof.

The invention provides fusion proteins and nucleic acids encoding them. A polypeptide of the invention can be fused to a heterologous peptide or polypeptide, such as N-terminal identification peptides which impart desired characteristics, such as increased stability or simplified purification. Peptides and polypeptides of the invention can also be synthesized and expressed as fusion proteins with one or more additional domains linked thereto for, e.g., producing a more immunogenic peptide, to more readily isolate a recombinantly synthesized peptide, to identify and isolate antibodies and antibody-expressing B cells, and the like. Detection and purification facilitating domains include, e.g., metal chelating peptides such as polyhistidine tracts and histidine-tryptophan modules that allow purification on immobilized metals, protein A domains that allow purification on immobilized immunoglobulin, and the domain utilized in the FLAGS extension/affinity purification system (Immunex Corp, Seattle Wash.). The inclusion of a cleavable linker sequences such as Factor Xa or enterokinase (Invitrogen, San Diego Calif.) between a purification domain and the motif-comprising peptide or polypeptide to facilitate purification. For example, an expression vector can include an epitope-encoding nucleic acid sequence linked to six histidine residues followed by a thioredoxin and an enterokinase cleavage site (see e.g., Williams (1995) Biochemistry 34:1787-1797; Dobeli (1998) Protein Expr. Purif. 12:404-414). The histidine residues facilitate detection and purification while the enterokinase cleavage site provides a means for purifying the epitope from the remainder of the fusion protein. Technology pertaining to vectors encoding fusion proteins and application of fusion proteins are well described in the scientific and patent literature, see e.g., Kroll (1993) DNA Cell. Biol., 12:441-53.

Transcriptional and Translational Control Sequences

The invention provides nucleic acid (e.g., DNA) sequences of the invention operatively linked to expression (e.g., transcriptional or translational) control sequence(s), e.g., promoters or enhancers, to direct or modulate RNA synthesis/expression. The expression control sequence can be in an expression vector. Exemplary bacterial promoters include lacI, lacZ, T3, T7, gpt, lambda PR, PL and trp. Exemplary eukaryotic promoters include CMV immediate early, HSV thymidine kinase, early and late SV40, LTRs from retrovirus, and mouse metallothionein I.

Promoters suitable for expressing a polypeptide in bacteria include the *E. coli* lac or trp promoters, the lacI promoter, the lacZ promoter, the T3 promoter, the T7 promoter, the gpt promoter, the lambda PR promoter, the lambda PL promoter, promoters from operons encoding glycolytic enzymes such as 3-phosphoglycerate kinase (PGK), and the acid phosphatase promoter. Eukaryotic promoters include the CMV immediate early promoter, the HSV thymidine kinase promoter, heat shock promoters, the early and late SV40 promoter, LTRs from retroviruses, and the mouse metallothionein-I promoter. Other promoters known to control expression of genes in prokaryotic or eukaryotic cells or their viruses may also be used.

Tissue-Specific Plant Promoters

The invention provides expression cassettes that can be expressed in a tissue-specific manner, e.g., that can express a protease of the invention in a tissue-specific manner. The invention also provides plants or seeds that express a protease of the invention in a tissue-specific manner. The tissue-specificity can be seed specific, stem specific, leaf specific, root specific, fruit specific and the like.

In one aspect, a constitutive promoter such as the CaMV 35S promoter can be used for expression in specific parts of the plant or seed or throughout the plant. For example, for overexpression, a plant promoter fragment can be employed which will direct expression of a nucleic acid in some or all tissues of a plant, e.g., a regenerated plant. Such promoters are referred to herein as "constitutive" promoters and are active under most environmental conditions and states of development or cell differentiation. Examples of constitutive promoters include the cauliflower mosaic virus (CaMV) 35S transcription initiation region, the 1'- or 2'-promoter derived from T-DNA of *Agrobacterium tumefaciens*, and other transcription initiation regions from various plant genes known to those of skill. Such genes include, e.g., ACT11 from *Arabidopsis* (Huang (1996) *Plant Mol. Biol.* 33:125-139); Cat3 from *Arabidopsis* (GenBank No. U43147, Zhong (1996) *Mol. Gen. Genet.* 251:196-203); the gene encoding stearoyl-acyl carrier protein desaturase from *Brassica napus* (GenBank No. X74782, Solocombe (1994) *Plant Physiol.* 104:1167-1176); GPc1 from maize (GenBank No. X15596; Martinez (1989) *J. Mol. Biol.* 208:551-565); the Gpc2 from maize (GenBank No. U45855, Manjunath (1997) *Plant Mol. Biol.* 33:97-112); plant promoters described in U.S. Pat. Nos. 4,962,028; 5,633,440.

The invention uses tissue-specific or constitutive promoters derived from viruses which can include, e.g., the tobamovirus subgenomic promoter (Kumagai (1995) Proc. Natl. Acad. Sci. USA 92:1679-1683; the rice tungro baciliform virus (RTBV), which replicates only in phloem cells in infected rice plants, with its promoter which drives strong phloem-specific reporter gene expression; the cassava vein mosaic virus (CVMV) promoter, with highest activity in vascular elements, in leaf mesophyll cells, and in root tips (Verdaguer (1996) Plant Mol. Biol. 31:1129-1139).

Alternatively, the plant promoter may direct expression of protease-expressing nucleic acid in a specific tissue, organ or cell type (i.e. tissue-specific promoters) or may be otherwise under more precise environmental or developmental control or under the control of an inducible promoter. Examples of environmental conditions that may affect transcription include anaerobic conditions, elevated temperature, the presence of light, or sprayed with chemicals/hormones. For example, the invention incorporates the drought-inducible promoter of maize (Busk (1997) supra); the cold, drought, and high salt inducible promoter from potato (Kirch (1997) Plant Mol. Biol. 33:897 909).

Tissue-specific promoters can promote transcription only within a certain time frame of developmental stage within that tissue. See, e.g., Blazquez (1998) Plant Cell 10:791-800, characterizing the *Arabidopsis* LEAFY gene promoter. See also Cardon (1997) *Plant J* 12:367-77, describing the transcription factor SPL3, which recognizes a conserved sequence motif in the promoter region of the *A. thaliana* floral meristem identity gene API; and Mandel (1995) Plant Molecular Biology, Vol. 29, pp 995-1004, describing the meristem promoter eIF4. Tissue specific promoters which are active throughout the life cycle of a particular tissue can be used. In one aspect, the nucleic acids of the invention are operably linked to a promoter active primarily only in cotton fiber cells. In one aspect, the nucleic acids of the invention are operably linked to a promoter active primarily during the stages of cotton fiber cell elongation, e.g., as described by Rinehart (1996) supra. The nucleic acids can be operably linked to the Fbl2A gene promoter to be preferentially expressed in cotton fiber cells (Ibid). See also, John (1997) Proc. Natl. Acad. Sci. USA 89:5769-5773; John, et al., U.S. Pat. Nos. 5,608,148 and 5,602,321, describing cotton fiber-specific promoters and methods for the construction of transgenic cotton plants. Root-specific promoters may also be used to express the nucleic acids of the invention. Examples of root-specific promoters include the promoter from the alcohol dehydrogenase gene (DeLisle (1990) Int. Rev. Cytol. 123:39-60). Other promoters that can be used to express the nucleic acids of the invention include, e.g., ovule-specific, embryo-specific, endosperm-specific, integument-specific, seed coat-specific promoters, or some combination thereof; a leaf-specific promoter (see, e.g., Busk (1997) Plant J. 11:1285 1295, describing a leaf-specific promoter in maize); the ORF13 promoter from *Agrobacterium rhizogenes* (which exhibits high activity in roots, see, e.g., Hansen (1997) supra); a maize pollen specific promoter (see, e.g., Guerrero (1990) Mol. Gen. Genet. 224:161 168); a tomato promoter active during fruit ripening, senescence and abscission of leaves and, to a lesser extent, of flowers can be used (see, e.g., Blume (1997) Plant J. 12:731 746); a pistil-specific promoter from the potato SK2 gene (see, e.g., Ficker (1997) Plant Mol. Biol. 35:425 431); the Blec4 gene from pea, which is active in epidermal tissue of vegetative and floral shoot apices of transgenic alfalfa making it a useful tool to target the expression of foreign genes to the epidermal layer of actively growing shoots or fibers; the ovule-specific BEL1 gene (see, e.g., Reiser (1995) Cell 83:735-742, GenBank No. U39944); and/or, the promoter in Klee, U.S. Pat. No. 5,589,583, describing a plant promoter region is capable of conferring high levels of transcription in meristematic tissue and/or rapidly dividing cells.

Alternatively, plant promoters which are inducible upon exposure to plant hormones, such as auxins, are used to express the nucleic acids of the invention. For example, the invention can use the auxin-response elements E1 promoter fragment (AuxREs) in the soybean (*Glycine max* L.) (Liu (1997) Plant Physiol. 115:397-407); the auxin-responsive *Arabidopsis* GST6 promoter (also responsive to salicylic acid and hydrogen peroxide) (Chen (1996) Plant J. 10: 955-966); the auxin-inducible parC promoter from tobacco (Sakai (1996) 37:906-913); a plant biotin response element (Streit (1997) Mol. Plant Microbe Interact. 10:933-937); and, the promoter responsive to the stress hormone abscisic acid (Sheen (1996) Science 274:1900-1902).

The nucleic acids of the invention can also be operably linked to plant promoters which are inducible upon exposure to chemicals reagents which can be applied to the plant, such as herbicides or antibiotics. For example, the maize In2-2 promoter, activated by benzenesulfonamide herbicide safeners, can be used (De Veylder (1997) Plant Cell Physiol. 38:568-577); application of different herbicide safeners induces distinct gene expression patterns, including expression in the root, hydathodes, and the shoot apical meristem. Coding sequence can be under the control of, e.g., a tetracycline-inducible promoter, e.g., as described with transgenic tobacco plants containing the *Avena sativa* L. (oat) arginine decarboxylase gene (Masgrau (1997) Plant J. 11:465-473); or, a salicylic acid-responsive element (Stange (1997) Plant J. 11:1315-1324). Using chemically- (e.g., hormone- or pesticide-) induced promoters, i.e., promoter responsive to a chemical which can be applied to the transgenic plant in the field, expression of a polypeptide of the invention can be induced at a particular stage of development of the plant. Thus, the invention also provides for transgenic plants containing an inducible gene encoding for polypeptides of the invention whose host range is limited to target plant species, such as corn, rice, barley, wheat, potato or other crops, inducible at any stage of development of the crop.

One of skill will recognize that a tissue-specific plant promoter may drive expression of operably linked sequences in tissues other than the target tissue. Thus, a tissue-specific promoter is one that drives expression preferentially in the target tissue or cell type, but may also lead to some expression in other tissues as well.

The nucleic acids of the invention can also be operably linked to plant promoters which are inducible upon exposure to chemicals reagents. These reagents include, e.g., herbicides, synthetic auxins, or antibiotics which can be applied, e.g., sprayed, onto transgenic plants. Inducible expression of the protease-producing nucleic acids of the invention will allow the grower to select plants with the optimal protease expression and/or activity. The development of plant parts can thus controlled. In this way the invention provides the means to facilitate the harvesting of plants and plant parts. For example, in various embodiments, the maize In2-2 promoter, activated by benzenesulfonamide herbicide safeners, is used (De Veylder (1997) Plant Cell Physiol. 38:568-577); application of different herbicide safeners induces distinct gene expression patterns, including expression in the root, hydathodes, and the shoot apical meristem. Coding sequences of the invention are also under the control of a tetracycline-inducible promoter, e.g., as described with transgenic tobacco plants containing the *Avena sativa* L. (oat) arginine decarboxylase gene (Masgrau (1997) Plant J. 11:465-473); or, a salicylic acid-responsive element (Stange (1997) Plant J. 11:1315-1324).

In some aspects, proper polypeptide expression may require polyadenylation region at the 3'-end of the coding region. The polyadenylation region can be derived from the natural gene, from a variety of other plant (or animal or other) genes, or from genes in the Agrobacterial T-DNA.

Expression Vectors and Cloning Vehicles

The invention provides expression vectors and cloning vehicles comprising nucleic acids of the invention, e.g., sequences encoding the proteases of the invention. Expression vectors and cloning vehicles of the invention can comprise viral particles, baculovirus, phage, plasmids, phagemids, cosmids, fosmids, bacterial artificial chromosomes, viral DNA (e.g., vaccinia, adenovirus, foul pox virus, pseudorabies and derivatives of SV40), P1-based artificial chromosomes, yeast plasmids, yeast artificial chromosomes, and any other vectors specific for specific hosts of interest (such as *bacillus*, *Aspergillus* and yeast). Vectors of the invention can include chromosomal, non-chromosomal and synthetic DNA sequences. Large numbers of suitable vectors are known to those of skill in the art, and are commercially available. Exemplary vectors are include: bacterial: pQE vectors (Qiagen), pBluescript plasmids, pNH vectors, (lambda-ZAP vectors (Stratagene); ptrc99a, pKK223-3, pDR540, pRIT2T (Pharmacia); Eukaryotic: pXT1, pSG5 (Stratagene), pSVK3, pBPV, pMSG, pSVLSV40 (Pharmacia). However, any other plasmid or other vector may be used so long as they are replicable and viable in the host. Low copy number or high copy number vectors may be employed with the present invention.

The expression vector can comprise a promoter, a ribosome binding site for translation initiation and a transcription terminator. The vector may also include appropriate sequences for amplifying expression. Mammalian expression vectors can comprise an origin of replication, any necessary ribosome binding sites, a polyadenylation site, splice donor and acceptor sites, transcriptional termination sequences, and 5' flanking non-transcribed sequences. In some aspects, DNA sequences derived from the SV40 splice and polyadenylation sites may be used to provide the required non-transcribed genetic elements.

In one aspect, the expression vectors contain one or more selectable marker genes to permit selection of host cells containing the vector. Such selectable markers include genes encoding dihydrofolate reductase or genes conferring neomycin resistance for eukaryotic cell culture, genes conferring tetracycline or ampicillin resistance in *E. coli*, and the *S. cerevisiae* TRP1 gene. Promoter regions can be selected from any desired gene using chloramphenicol transferase (CAT) vectors or other vectors with selectable markers.

Vectors for expressing the polypeptide or fragment thereof in eukaryotic cells can also contain enhancers to increase expression levels. Enhancers are cis-acting elements of DNA, usually from about 10 to about 300 bp in length that act on a promoter to increase its transcription. Examples include the SV40 enhancer on the late side of the replication origin bp 100 to 270, the cytomegalovirus early promoter enhancer, the polyoma enhancer on the late side of the replication origin, and the adenovirus enhancers.

A nucleic acid sequence can be inserted into a vector by a variety of procedures. In general, the sequence is ligated to the desired position in the vector following digestion of the insert and the vector with appropriate restriction endonucleases. Alternatively, blunt ends in both the insert and the vector may be ligated. A variety of cloning techniques are known in the art, e.g., as described in Ausubel and Sambrook. Such procedures and others are deemed to be within the scope of those skilled in the art.

The vector can be in the form of a plasmid, a viral particle, or a phage. Other vectors include chromosomal, non-chromosomal and synthetic DNA sequences, derivatives of SV40; bacterial plasmids, phage DNA, baculovirus, yeast plasmids, vectors derived from combinations of plasmids and phage DNA, viral DNA such as vaccinia, adenovirus, fowl pox virus, and pseudorabies. A variety of cloning and expression vectors for use with prokaryotic and eukaryotic hosts are described by, e.g., Sambrook.

Particular bacterial vectors which can be used include the commercially available plasmids comprising genetic elements of the well known cloning vector pBR322 (ATCC 37017), pKK223-3 (Pharmacia Fine Chemicals, Uppsala, Sweden), GEM1 (Promega Biotec, Madison, Wis., USA) pQE70, pQE60, pQE-9 (Qiagen), pD10, psiX174 pBluescript II KS, pNH8A, pNH16a, pNH18A, pNH46A (Stratagene), ptrc99a, pKK223-3, pKK233-3, DR540, pRIT5 (Pharmacia), pKK232-8 and pCM7. Particular eukaryotic vectors include pSV2CAT, pOG44, pXT1, pSG (Stratagene) pSVK3, pBPV, pMSG, and pSVL (Pharmacia). However, any other vector may be used as long as it is replicable and viable in the host cell.

The nucleic acids of the invention can be expressed in expression cassettes, vectors or viruses and transiently or stably expressed in plant cells and seeds. One exemplary transient expression system uses episomal expression systems, e.g., cauliflower mosaic virus (CaMV) viral RNA generated in the nucleus by transcription of an episomal mini-chromosome containing supercoiled DNA, see, e.g., Covey (1990) Proc. Natl. Acad. Sci. USA 87:1633-1637. Alternatively, coding sequences, i.e., all or sub-fragments of sequences of the invention can be inserted into a plant host cell genome becoming an integral part of the host chromosomal DNA. Sense or antisense transcripts can be expressed in this manner. A vector comprising the sequences (e.g., promoters or coding regions) from nucleic acids of the invention can comprise a marker gene that confers a selectable phenotype on a plant cell or a seed. For example, the marker may encode biocide resistance, particularly antibiotic resistance, such as resistance to kanamycin, G418, bleomycin, hygromycin, or herbicide resistance, such as resistance to chlorosulfuron or Basta.

Expression vectors capable of expressing nucleic acids and proteins in plants are well known in the art, and can include, e.g., vectors from *Agrobacterium* spp.; potato virus X (see, e.g., Angell (1997) EMBO J. 16:3675-3684), tobacco mosaic virus (see, e.g., Casper (1996) Gene 173:69-73), tomato bushy stunt virus (see, e.g., Hillman (1989) Virology 169:42-50), tobacco etch virus (see, e.g., Dolja (1997) Virology 234: 243-252), bean golden mosaic virus (see, e.g., Morinaga (1993) Microbiol Immunol. 37:471-476), cauliflower mosaic virus (see, e.g., Cecchini (1997) Mol. Plant Microbe Interact. 10:1094-1101), maize Ac/Ds transposable element (see, e.g., Rubin (1997) Mol. Cell. Biol. 17:6294-6302; Kunze (1996) Curr. Top. Microbiol. Immunol. 204:161-194), and the maize suppressor-mutator (Spm) transposable element (see, e.g., Schlappi (1996) Plant Mol. Biol. 32:717-725); and derivatives thereof.

In one aspect, the expression vector can have two replication systems to allow it to be maintained in two organisms, for example in mammalian or insect cells for expression and in a prokaryotic host for cloning and amplification. Furthermore, for integrating expression vectors, the expression vector can contain at least one sequence homologous to the host cell genome. It can contain two homologous sequences which flank the expression construct. The integrating vector can be directed to a specific locus in the host cell by selecting the appropriate homologous sequence for inclusion in the vector. Constructs for integrating vectors are well known in the art.

Expression vectors of the invention may also include a selectable marker gene to allow for the selection of bacterial strains that have been transformed, e.g., genes which render the bacteria resistant to drugs such as ampicillin, chloramphenicol, erythromycin, kanamycin, neomycin and tetracycline. Selectable markers can also include biosynthetic genes, such as those in the histidine, tryptophan and leucine biosynthetic pathways.

Host Cells and Transformed Cells

The invention also provides a transformed cell comprising a nucleic acid sequence of the invention, e.g., a sequence encoding a protease of the invention, or a vector of the invention. The host cell may be any of the host cells familiar to those skilled in the art, including prokaryotic cells, eukaryotic cells, such as bacterial cells, fungal cells, yeast cells, mammalian cells, insect cells, or plant cells. Exemplary bacterial cells include *E. coli, Streptomyces, Bacillus subtilis, Salmonella typhimurium* and various species within the genera *Pseudomonas, Streptomyces*, and *Staphylococcus*. Exemplary insect cells include *Drosophila* S2 and *Spodoptera* Sf9. Exemplary animal cells include CHO, COS or Bowes melanoma or any mouse or human cell line. The selection of an appropriate host is within the abilities of those skilled in the art. Techniques for transforming a wide variety of higher plant species are well known and described in the technical and scientific literature. See, e.g., Weising (1988) Ann. Rev. Genet. 22:421-477; U.S. Pat. No. 5,750,870.

The vector can be introduced into the host cells using any of a variety of techniques, including transformation, transfection, transduction, viral infection, gene guns, or Ti-mediated gene transfer. Particular methods include calcium phosphate transfection, DEAE-Dextran mediated transfection, lipofection, or electroporation (Davis, L., Dibner, M., Battey, I., Basic Methods in Molecular Biology, (1986)).

In one aspect, the nucleic acids or vectors of the invention are introduced into the cells for screening, thus, the nucleic acids enter the cells in a manner suitable for subsequent expression of the nucleic acid. The method of introduction is largely dictated by the targeted cell type. Exemplary methods include $CaPO_4$ precipitation, liposome fusion, lipofection (e.g., LIPOFECTIN™), electroporation, viral infection, etc. The candidate nucleic acids may stably integrate into the genome of the host cell (for example, with retroviral introduction) or may exist either transiently or stably in the cytoplasm (i.e. through the use of traditional plasmids, utilizing standard regulatory sequences, selection markers, etc.). As many pharmaceutically important screens require human or model mammalian cell targets, retroviral vectors capable of transfecting such targets are preferred.

Where appropriate, the engineered host cells can be cultured in conventional nutrient media modified as appropriate for activating promoters, selecting transformants or amplifying the genes of the invention. Following transformation of a suitable host strain and growth of the host strain to an appropriate cell density, the selected promoter may be induced by appropriate means (e.g., temperature shift or chemical induction) and the cells may be cultured for an additional period to allow them to produce the desired polypeptide or fragment thereof.

Cells can be harvested by centrifugation, disrupted by physical or chemical means, and the resulting crude extract is retained for further purification. Microbial cells employed for expression of proteins can be disrupted by any convenient method, including freeze-thaw cycling, sonication, mechanical disruption, or use of cell lysing agents. Such methods are well known to those skilled in the art. The expressed polypeptide or fragment thereof can be recovered and purified from recombinant cell cultures by methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Protein refolding steps can be used, as necessary, in completing configuration of the polypeptide. If desired, high performance liquid chromatography (HPLC) can be employed for final purification steps.

Various mammalian cell culture systems can also be employed to express recombinant protein. Examples of mammalian expression systems include the COS-7 lines of monkey kidney fibroblasts and other cell lines capable of expressing proteins from a compatible vector, such as the C127, 3T3, CHO, HeLa and BHK cell lines.

The constructs in host cells can be used in a conventional manner to produce the gene product encoded by the recombinant sequence. Depending upon the host employed in a recombinant production procedure, the polypeptides produced by host cells containing the vector may be glycosylated or may be non-glycosylated. Polypeptides of the invention may or may not also include an initial methionine amino acid residue.

Cell-free translation systems can also be employed to produce a polypeptide of the invention. Cell-free translation systems can use mRNAs transcribed from a DNA construct comprising a promoter operably linked to a nucleic acid encoding the polypeptide or fragment thereof. In some aspects, the DNA construct may be linearized prior to conducting an in vitro transcription reaction. The transcribed mRNA is then incubated with an appropriate cell-free translation extract, such as a rabbit reticulocyte extract, to produce the desired polypeptide or fragment thereof.

The expression vectors can contain one or more selectable marker genes to provide a phenotypic trait for selection of transformed host cells such as dihydrofolate reductase or neomycin resistance for eukaryotic cell culture, or such as tetracycline or ampicillin resistance in *E. coli*.

Amplification of Nucleic Acids

In practicing the invention, nucleic acids of the invention and nucleic acids encoding the proteases of the invention, or modified nucleic acids of the invention, can be reproduced by amplification. Amplification can also be used to clone or modify the nucleic acids of the invention. Thus, the invention provides amplification primer sequence pairs for amplifying nucleic acids of the invention. One of skill in the art can design amplification primer sequence pairs for any part of or the full length of these sequences.

In one aspect, the invention provides a nucleic acid amplified by a primer pair of the invention, e.g., a primer pair as set forth by about the first (the 5') 12, 13, 14, 15, 16, 17, 18, 19, 20, 21, 22, 23, 24, 25, 26, 27, 28, 29 or 30 or more residues of a nucleic acid of the invention, and about the first (the 5') 15, 16, 17, 18, 19, 20, 21, 22, 23, 24, or 25 residues of the complementary strand (e.g., of SEQ ID NO:1; SEQ ID NO:3; SEQ ID NO:5; SEQ ID NO:7; SEQ ID NO:9; SEQ ID NO:11; SEQ ID NO:13; SEQ ID NO:15; SEQ ID NO:17; SEQ ID NO:19; SEQ ID NO:21; SEQ ID NO:23; SEQ ID NO:25; SEQ ID NO:27; SEQ ID NO:29; SEQ ID NO:31; SEQ ID NO:33; SEQ ID NO:35; SEQ ID NO:37; SEQ ID NO:39; SEQ ID NO:41; SEQ ID NO:43; SEQ ID NO:45; SEQ ID NO:47; SEQ ID NO:49; SEQ ID NO:51; SEQ ID NO:53; SEQ ID NO:55; SEQ ID NO:57; SEQ ID NO:59; SEQ ID NO:61; SEQ ID NO:63; SEQ ID NO:65; SEQ ID NO:67; SEQ ID NO:69; SEQ ID NO:71; SEQ ID NO:73; SEQ ID NO:75; SEQ ID NO:77; SEQ ID NO:79; SEQ ID NO:81; SEQ ID NO:83; SEQ ID NO:85; SEQ ID NO:87; SEQ ID NO:89; SEQ ID NO:91; SEQ ID NO:93; SEQ ID NO:95; SEQ ID NO:97; SEQ ID NO:99; SEQ ID NO:101; SEQ ID NO:103; SEQ ID NO:105; SEQ ID NO:107; SEQ ID NO:109; SEQ ID NO:11; SEQ ID NO:113; SEQ ID NO:115; SEQ ID NO:117; SEQ ID NO:119; SEQ ID NO:121; SEQ ID NO:123; SEQ ID NO:125; SEQ ID NO:127; SEQ ID NO:129; SEQ ID NO:131; SEQ ID NO:133; SEQ ID NO:135; SEQ ID NO:137; SEQ ID NO:139; SEQ ID NO:141; SEQ ID NO:143; SEQ ID NO:145; SEQ ID NO:146; SEQ ID NO:150; SEQ ID NO:158; SEQ ID NO:164; SEQ ID NO:171; SEQ ID NO:179; SEQ ID NO:187; SEQ ID NO:193; SEQ ID NO:199; SEQ ID NO:204; SEQ ID NO:210; SEQ ID NO:218; SEQ ID NO:222; SEQ ID NO:229; SEQ ID NO:234; SEQ ID NO:241; SEQ ID NO:248 and/or SEQ ID NO:254).

The invention provides an amplification primer sequence pair for amplifying a nucleic acid encoding a polypeptide having a protease activity, wherein the primer pair is capable of amplifying a nucleic acid comprising a sequence of the invention, or fragments or subsequences thereof. One or each member of the amplification primer sequence pair can comprise an oligonucleotide comprising at least about 10 to 50 consecutive bases of the sequence, or about 12, 13, 14, 15, 16, 17, 18, 19, 20, 21, 22, 23, 24, or 25 consecutive bases of the sequence. The invention provides amplification primer pairs, wherein the primer pair comprises a first member having a sequence as set forth by about the first (the 5') 12, 13, 14, 15, 16, 17, 18, 19, 20, 21, 22, 23, 24, or 25 residues of a nucleic acid of the invention, and a second member having a sequence as set forth by about the first (the 5') 12, 13, 14, 15, 16, 17, 18, 19, 20, 21, 22, 23, 24, or 25 residues of the complementary strand of the first member. The invention provides proteases generated by amplification, e.g., polymerase chain reaction (PCR), using an amplification primer pair of the invention. The invention provides methods of making a protease by amplification, e.g., polymerase chain reaction (PCR), using an amplification primer pair of the invention. In one aspect, the amplification primer pair amplifies a nucleic acid from a library, e.g., a gene library, such as an environmental library.

Amplification reactions can also be used to quantify the amount of nucleic acid in a sample (such as the amount of message in a cell sample), label the nucleic acid (e.g., to apply it to an array or a blot), detect the nucleic acid, or quantify the amount of a specific nucleic acid in a sample. In one aspect of the invention, message isolated from a cell or a cDNA library are amplified.

The skilled artisan can select and design suitable oligonucleotide amplification primers. Amplification methods are also well known in the art, and include, e.g., polymerase chain reaction, PCR (see, e.g., PCR PROTOCOLS, A GUIDE TO METHODS AND APPLICATIONS, ed. Innis, Academic Press, N.Y. (1990) and PCR STRATEGIES (1995), ed. Innis, Academic Press, Inc., N.Y., ligase chain reaction (LCR) (see, e.g., Wu (1989) Genomics 4:560; Landegren (1988) Science 241:1077; Barringer (1990) Gene 89:117); transcription amplification (see, e.g., Kwoh (1989) Proc. Natl. Acad. Sci. USA 86:1173); and, self-sustained sequence replication (see, e.g., Guatelli (1990) Proc. Natl. Acad. Sci. USA 87:1874); Q Beta replicase amplification (see, e.g., Smith (1997) J. Clin. Microbiol. 35:1477-1491), automated Q-beta replicase amplification assay (see, e.g., Burg (1996) Mol. Cell. Probes 10:257-271) and other RNA polymerase mediated techniques (e.g., NASBA, Cangene, Mississauga, Ontario); see also Berger (1987) Methods Enzymol. 152:307-316; Sambrook; Ausubel; U.S. Pat. Nos. 4,683,195 and 4,683,202; Sooknanan (1995) Biotechnology 13:563-564.

Determining the Degree of Sequence Identity

The invention provides nucleic acids comprising sequences having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary nucleic acid of the invention (e.g., SEQ ID NO:1; SEQ ID NO:3; SEQ ID NO:5; SEQ ID NO:7; SEQ ID NO:9; SEQ ID NO:11; SEQ ID NO:13; SEQ ID NO:15; SEQ ID NO:17; SEQ ID NO:19; SEQ ID NO:21; SEQ ID NO:23; SEQ ID NO:25; SEQ ID NO:27; SEQ ID NO:29; SEQ ID NO:31; SEQ ID NO:33; SEQ ID NO:35; SEQ ID NO:37; SEQ ID NO:39; SEQ ID NO:41; SEQ ID NO:43; SEQ ID NO:45; SEQ ID NO:47; SEQ ID NO:49; SEQ ID NO:51; SEQ ID NO:53; SEQ ID NO:55; SEQ ID NO:57; SEQ ID NO:59; SEQ ID NO:61; SEQ ID NO:63; SEQ ID NO:65; SEQ ID NO:67; SEQ ID NO:69; SEQ ID NO:71; SEQ ID NO:73; SEQ ID NO:75; SEQ ID NO:77; SEQ ID NO:79; SEQ ID NO:81; SEQ ID NO:83; SEQ ID NO:85; SEQ ID NO:87; SEQ ID NO:89; SEQ ID NO:91; SEQ ID NO:93; SEQ ID NO:95; SEQ ID NO:97; SEQ ID NO:99; SEQ ID NO:101; SEQ ID NO:103; SEQ ID NO:105; SEQ ID NO:107; SEQ ID NO:109; SEQ ID NO:111; SEQ ID NO:113; SEQ ID NO:115; SEQ ID NO:117; SEQ ID NO:119; SEQ ID NO:121; SEQ ID NO:123; SEQ ID NO:125; SEQ ID NO:127; SEQ ID NO:129; SEQ ID NO:131; SEQ ID NO:133; SEQ ID NO:135; SEQ ID NO:137; SEQ ID NO:139; SEQ ID NO:141; SEQ ID NO:143; SEQ ID NO:145; SEQ ID NO:146; SEQ ID NO:150; SEQ ID NO:158; SEQ ID NO:164; SEQ ID NO:171; SEQ ID NO:179; SEQ ID NO:187; SEQ ID NO:193; SEQ ID NO:199; SEQ ID NO:204; SEQ ID NO:210; SEQ ID NO:218; SEQ ID NO:222; SEQ ID NO:229; SEQ ID NO:234; SEQ ID NO:241; SEQ ID NO:248 and/or SEQ ID NO:254, and nucleic acids encoding SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:10, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132; SEQ ID NO:134; SEQ ID NO:136; SEQ ID NO:138; SEQ ID NO:140; SEQ ID NO:142; SEQ ID NO:144 and/or SEQ ID NO:147) over a region of at least about 50, 75, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550 or more, residues. The invention provides polypeptides comprising sequences having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary polypeptide of the invention. The extent of sequence identity (homology) may be determined using any computer program and associated parameters, including those described herein, such as BLAST 2.2.2. or FASTA version 3.0t78, with the default parameters.

Homologous sequences also include RNA sequences in which uridines replace the thymines in the nucleic acid sequences. The homologous sequences may be obtained using any of the procedures described herein or may result from the correction of a sequencing error. It will be appreciated that the nucleic acid sequences as set forth herein can be represented in the traditional single character format (see, e.g., Stryer, Lubert. Biochemistry, 3rd Ed., W.H Freeman & Co., New York) or in any other format which records the identity of the nucleotides in a sequence.

Various sequence comparison programs identified herein are used in this aspect of the invention. Protein and/or nucleic acid sequence identities (homologies) may be evaluated using any of the variety of sequence comparison algorithms and programs known in the art. Such algorithms and programs include, but are not limited to, TBLASTN, BLASTP, FASTA, TFASTA, and CLUSTALW (Pearson and Lipman, Proc. Natl. Acad. Sci. USA 85(8):2444-2448, 1988; Altschul et al., J. Mol. Biol. 215(3):403-410, 1990; Thompson et al., Nucleic Acids Res. 22(2):4673-4680, 1994; Higgins et al., Methods Enzymol. 266:383-402, 1996; Altschul et al., J. Mol. Biol. 215(3):403-410, 1990; Altschul et al., Nature Genetics 3:266-272, 1993).

Homology or identity can be measured using sequence analysis software (e.g., Sequence Analysis Software Package of the Genetics Computer Group, University of Wisconsin Biotechnology Center, 1710 University Avenue, Madison, Wis. 53705). Such software matches similar sequences by assigning degrees of homology to various deletions, substitutions and other modifications. The terms "homology" and "identity" in the context of two or more nucleic acids or polypeptide sequences, refer to two or more sequences or subsequences that are the same or have a specified percentage of amino acid residues or nucleotides that are the same when compared and aligned for maximum correspondence over a comparison window or designated region as measured using any number of sequence comparison algorithms or by manual alignment and visual inspection. For sequence comparison, one sequence can act as a reference sequence, e.g., a sequence of the invention, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters.

A "comparison window", as used herein, includes reference to a segment of any one of the numbers of contiguous residues. For example, in alternative aspects of the invention, contiguous residues ranging anywhere from 20 to the full length of an exemplary polypeptide or nucleic acid sequence of the invention are compared to a reference sequence of the same number of contiguous positions after the two sequences are optimally aligned. If the reference sequence has the requisite sequence identity to an exemplary polypeptide or nucleic acid sequence of the invention, e.g., 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a sequence of the invention, that sequence is within the scope of the invention. In alternative embodiments, subsequences ranging from about 20 to 600, about 50 to 200, and about 100 to 150 are compared to a reference sequence of the same number of contiguous positions after the two sequences are optimally aligned. Methods of alignment of sequence for comparison are well known in the art. Optimal alignment of sequences for comparison can be conducted, e.g., by the local homology algorithm of Smith & Waterman, Adv. Appl. Math. 2:482, 1981, by the homology alignment algorithm of Needleman & Wunsch, J. Mol. Biol. 48:443, 1970, by the search for similarity method of person & Lipman, Proc. Nat'l. Acad. Sci. USA 85:2444, 1988, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection. Other algorithms for determining homology or identity include, for example, in addition to a BLAST program (Basic Local Alignment Search Tool at the National Center for Biological Information), ALIGN, AMAS (Analysis of Multiply Aligned Sequences), AMPS (Protein Multiple Sequence Alignment), ASSET (Aligned Segment Statistical Evaluation Tool), BANDS, BESTSCOR, BIOSCAN (Biological Sequence Comparative Analysis Node), BLIMPS (BLocks IMProved Searcher), FASTA, Intervals & Points, BMB, CLUSTAL V, CLUSTAL W, CONSENSUS, LCONSENSUS, WCONSENSUS, Smith-Waterman algorithm, DARWIN, Las Vegas algorithm, FNAT (Forced Nucleotide Alignment Tool), Framealign, Framesearch, DYNAMIC, FILTER, FSAP (Fristensky Sequence Analysis Package), GAP (Global Alignment Program), GENAL, GIBBS, GenQuest, ISSC (Sensitive Sequence Comparison), LALIGN (Local Sequence Alignment), LCP (Local Content Program), MACAW (Multiple Alignment Construction & Analysis Workbench), MAP (Multiple Alignment Program), MBLKP, MBLKN, PIMA (Pattern-Induced Multi-sequence Alignment), SAGA (Sequence Alignment by Genetic Algorithm) and WHAT-IF. Such alignment programs can also be used to screen genome databases to identify polynucleotide sequences having substantially identical sequences. A number of genome databases are available, for example, a substantial portion of the human genome is available as part of the Human Genome Sequencing Project (Gibbs, 1995). Several genomes have been sequenced, e.g., *M. genitalium* (Fraser et al., 1995), *M. jannaschii* (Bult et al., 1996), *H. influenzae* (Fleischmann et al., 1995), *E. coli* (Blattner et al., 1997), and yeast (*S. cerevisiae*) (Mewes et al., 1997), and *D. melanogaster* (Adams et al., 2000). Significant progress has also been made in sequencing the genomes of model organism, such as mouse, *C. elegans*, and *Arabadopsis* sp. Databases containing genomic information annotated with some functional information are maintained by different organization, and are accessible via the internet.

BLAST, BLAST 2.0 and BLAST 2.2.2 algorithms are also used to practice the invention. They are described, e.g., in Altschul (1977) Nuc. Acids Res. 25:3389-3402; Altschul (1990) J. Mol. Biol. 215:403-410. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul (1990) supra). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4 and a comparison of both strands. For amino acid sequences, the BLASTP program uses as defaults a wordlength of 3, and expectations (E) of 10, and the BLOSUM62 scoring matrix (see Henikoff & Henikoff (1989) Proc. Natl. Acad. Sci. USA 89:10915) alignments (B) of 50, expectation (E) of 10, M=5, N=−4, and a comparison of both strands. The BLAST algorithm also performs a statistical analysis of the similarity between two sequences (see, e.g., Karlin & Altschul (1993) Proc. Natl. Acad. Sci. USA 90:5873). One measure of similarity provided by BLAST algorithm is the smallest sum probability (P(N)), which provides an indication of the probability by which a match between two nucleotide or amino acid sequences would occur by chance. For example, a nucleic acid is considered similar to a references sequence if the smallest sum probability in a comparison of the test nucleic acid to the reference nucleic acid is less than about 0.2, more preferably less than about 0.01, and most preferably less than about 0.001. In one aspect, protein and nucleic acid sequence homologies are evaluated using the Basic Local Alignment Search Tool ("BLAST"). For example, five specific BLAST programs can be used to perform the following task: (1) BLASTP and BLAST3 compare an amino acid query sequence against a protein sequence database; (2) BLASTN compares a nucleotide query sequence against a nucleotide sequence database; (3) BLASTX compares the six-frame conceptual translation products of a query nucleotide sequence (both strands) against a protein sequence database; (4) TBLASTN compares a query protein sequence against a nucleotide sequence database translated in all six reading frames (both strands); and, (5) TBLASTX compares the six-frame translations of a nucleotide query sequence against the six-frame translations of a nucleotide sequence database. The BLAST programs identify homologous sequences by identifying similar segments, which are referred to herein as "high-scoring segment pairs," between a query amino or nucleic acid sequence and a test sequence which is preferably obtained from a protein or nucleic acid sequence database. High-scoring segment pairs are preferably identified (i.e., aligned) by means of a scoring matrix, many of which are known in the art. Preferably, the scoring matrix used is the BLOSUM62 matrix (Gonnet et al., Science 256:1443-1445, 1992; Henikoff and Henikoff, Proteins 17:49-61, 1993). Less preferably, the PAM or PAM250 matrices may also be used (see, e.g., Schwartz and Dayhoff, eds., 1978, Matrices for Detecting Distance Relationships: Atlas of Protein Sequence and Structure, Washington: National Biomedical Research Foundation).

In one aspect of the invention, to determine if a nucleic acid has the requisite sequence identity to be within the scope of the invention, the NCBI BLAST 2.2.2 programs is used, default options to blastp. There are about 38 setting options in the BLAST 2.2.2 program. In this exemplary aspect of the invention, all default values are used except for the default filtering setting (i.e., all parameters set to default except filtering which is set to OFF); in its place a "-F F" setting is used, which disables filtering. Use of default filtering often results in Karlin-Altschul violations due to short length of sequence.

The default values used in this exemplary aspect of the invention include:

"Filter for low complexity: ON
Word Size: 3
Matrix: Blosum62
Gap Costs: Existence: 11
Extension: 1"

Other default settings can be: filter for low complexity OFF, word size of 3 for protein, BLOSUM62 matrix, gap existence penalty of −11 and a gap extension penalty of −1. An exemplary NCBI BLAST 2.2.2 program setting has the "-W" option default to 0. This means that, if not set, the word size defaults to 3 for proteins and 1 for nucleotides.

Computer Systems and Computer Program Products

To determine and identify sequence identities, structural homologies, motifs and the like in silico, the sequence of the invention can be stored, recorded, and manipulated on any medium which can be read and accessed by a computer. Accordingly, the invention provides computers, computer systems, computer readable mediums, computer programs products and the like recorded or stored thereon the nucleic acid and polypeptide sequences of the invention. As used herein, the words "recorded" and "stored" refer to a process for storing information on a computer medium. A skilled artisan can readily adopt any known methods for recording information on a computer readable medium to generate manufactures comprising one or more of the nucleic acid and/or polypeptide sequences of the invention.

Another aspect of the invention is a computer readable medium having recorded thereon at least one nucleic acid and/or polypeptide sequence of the invention. Computer readable media include magnetically readable media, optically readable media, electronically readable media and magnetic/optical media. For example, the computer readable media may be a hard disk, a floppy disk, a magnetic tape, CD-ROM, Digital Versatile Disk (DVD), Random Access Memory (RAM), or Read Only Memory (ROM) as well as other types of other media known to those skilled in the art.

Aspects of the invention include systems (e.g., internet based systems), particularly computer systems, which store and manipulate the sequences and sequence information described herein. One example of a computer system 100 is illustrated in block diagram form in FIG. 1. As used herein, "a computer system" refers to the hardware components, software components, and data storage components used to analyze a nucleotide or polypeptide sequence of the invention. The computer system 100 can include a processor for processing, accessing and manipulating the sequence data. The processor 105 can be any well-known type of central processing unit, such as, for example, the Pentium III from Intel Corporation, or similar processor from Sun, Motorola, Compaq, AMD or International Business Machines. The computer system 100 is a general purpose system that comprises the processor 105 and one or more internal data storage components 110 for storing data, and one or more data retrieving devices for retrieving the data stored on the data storage components. A skilled artisan can readily appreciate that any one of the currently available computer systems are suitable.

In one aspect, the computer system 100 includes a processor 105 connected to a bus which is connected to a main memory 115 (preferably implemented as RAM) and one or more internal data storage devices 110, such as a hard drive and/or other computer readable media having data recorded thereon. The computer system 100 can further include one or more data retrieving device 118 for reading the data stored on the internal data storage devices 110. The data retrieving device 118 may represent, for example, a floppy disk drive, a compact disk drive, a magnetic tape drive, or a modem capable of connection to a remote data storage system (e.g., via the internet) etc. In some embodiments, the internal data storage device 110 is a removable computer readable medium such as a floppy disk, a compact disk, a magnetic tape, etc. containing control logic and/or data recorded thereon. The computer system 100 may advantageously include or be programmed by appropriate software for reading the control logic and/or the data from the data storage component once inserted in the data retrieving device. The computer system 100 includes a display 120 which is used to display output to a computer user. It should also be noted that the computer system 100 can be linked to other computer systems 125a-c in a network or wide area network to provide centralized access to the computer system 100. Software for accessing and processing the nucleotide or amino acid sequences of the invention can reside in main memory 115 during execution. In some aspects, the computer system 100 may further comprise a sequence comparison algorithm for comparing a nucleic acid sequence of the invention. The algorithm and sequence(s) can be stored on a computer readable medium. A "sequence comparison algorithm" refers to one or more programs which are implemented (locally or remotely) on the computer system 100 to compare a nucleotide sequence with other nucleotide sequences and/or compounds stored within a data storage means. For example, the sequence comparison algorithm may compare the nucleotide sequences of the invention stored on a computer readable medium to reference sequences stored on a computer readable medium to identify homologies or structural motifs.

Figure 2:
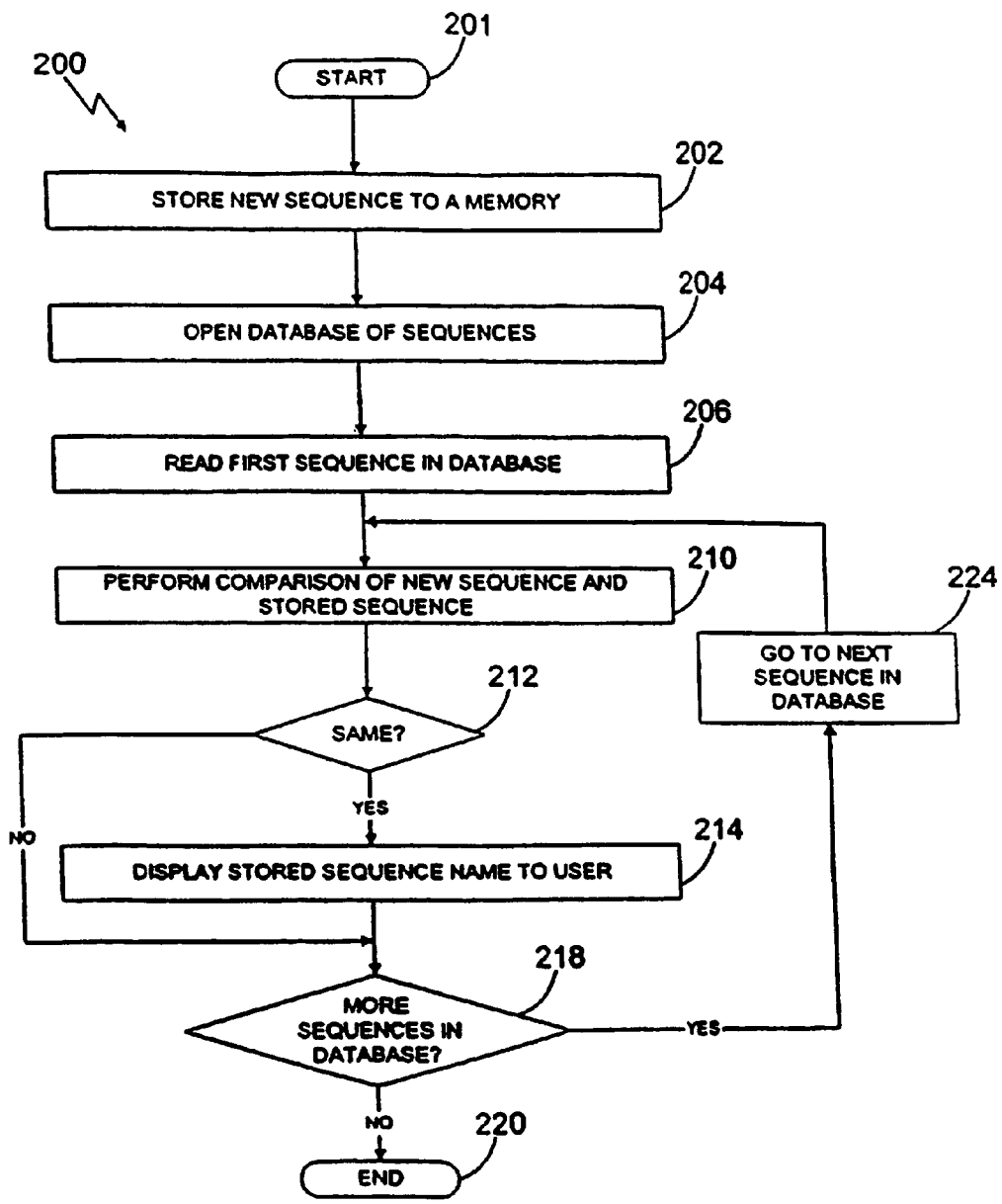
FIG. 2 is a flow diagram illustrating one aspect of a process for comparing a new nucleotide or protein sequence with a database of sequences in order to determine the homology levels between the new sequence and the sequences in the database.
Figure 3:
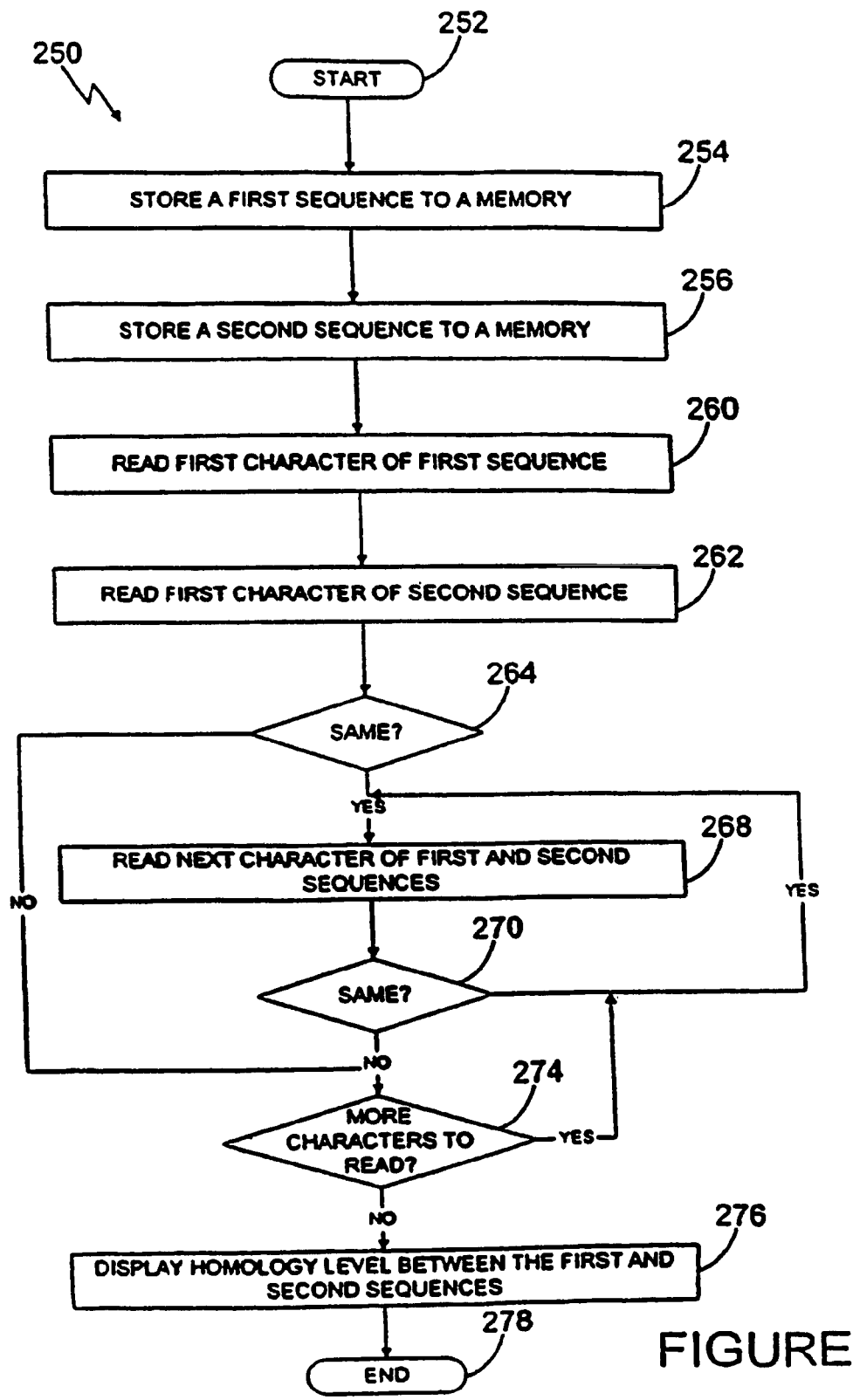
FIG. 3 is a flow diagram illustrating one aspect of a process in a computer for determining whether two sequences are homologous.

The parameters used with the above algorithms may be adapted depending on the sequence length and degree of homology studied. In some aspects, the parameters may be the default parameters used by the algorithms in the absence of instructions from the user. FIG. 2 is a flow diagram illustrating one aspect of a process 200 for comparing a new nucleotide or protein sequence with a database of sequences in order to determine the homology levels between the new sequence and the sequences in the database. The database of sequences can be a private database stored within the computer system 100, or a public database such as GENBANK that is available through the Internet. The process 200 begins at a start state 201 and then moves to a state 202 wherein the new sequence to be compared is stored to a memory in a computer system 100. As discussed above, the memory could be any type of memory, including RAM or an internal storage device. The process 200 then moves to a state 204 wherein a database of sequences is opened for analysis and comparison. The process 200 then moves to a state 206 wherein the first sequence stored in the database is read into a memory on the computer. A comparison is then performed at a state 210 to determine if the first sequence is the same as the second sequence. It is important to note that this step is not limited to performing an exact comparison between the new sequence and the first sequence in the database. Well-known methods are known to those of skill in the art for comparing two nucleotide or protein sequences, even if they are not identical. For example, gaps can be introduced into one sequence in order to raise the homology level between the two tested sequences. The parameters that control whether gaps or other features are introduced into a sequence during comparison are normally entered by the user of the computer system. Once a comparison of the two sequences has been performed at the state 210, a determination is made at a decision state 210 whether the two sequences are the same. Of course, the term "same" is not limited to sequences that are absolutely identical. Sequences that are within the homology parameters entered by the user will be marked as "same" in the process 200. If a determination is made that the two sequences are the same, the process 200 moves to a state 214 wherein the name of the sequence from the database is displayed to the user. This state notifies the user that the sequence with the displayed name fulfills the homology constraints that were entered. Once the name of the stored sequence is displayed to the user, the process 200 moves to a decision state 218 wherein a determination is made whether more sequences exist in the database. If no more sequences exist in the database, then the process 200 terminates at an end state 220. However, if more sequences do exist in the database, then the process 200 moves to a state 224 wherein a pointer is moved to the next sequence in the database so that it can be compared to the new sequence. In this manner, the new sequence is aligned and compared with every sequence in the database. It should be noted that if a determination had been made at the decision state 212 that the sequences were not homologous, then the process 200 would move immediately to the decision state 218 in order to determine if any other sequences were available in the database for comparison. Accordingly, one aspect of the invention is a computer system comprising a processor, a data storage device having stored thereon a nucleic acid sequence of the invention and a sequence comparer for conducting the comparison. The sequence comparer may indicate a homology level between the sequences compared or identify structural motifs, or it may identify structural motifs in sequences which are compared to these nucleic acid codes and polypeptide codes. FIG. 3 is a flow diagram illustrating one embodiment of a process 250 in a computer for determining whether two sequences are homologous. The process 250 begins at a start state 252 and then moves to a state 254 wherein a first sequence to be compared is stored to a memory. The second sequence to be compared is then stored to a memory at a state 256. The process 250 then moves to a state 260 wherein the first character in the first sequence is read and then to a state 262 wherein the first character of the second sequence is read. It should be understood that if the sequence is a nucleotide sequence, then the character would normally be either A, T, C, G or U. If the sequence is a protein sequence, then it can be a single letter amino acid code so that the first and sequence sequences can be easily compared. A determination is then made at a decision state 264 whether the two characters are the same. If they are the same, then the process 250 moves to a state 268 wherein the next characters in the first and second sequences are read. A determination is then made whether the next characters are the same. If they are, then the process 250 continues this loop until two characters are not the same. If a determination is made that the next two characters are not the same, the process 250 moves to a decision state 274 to determine whether there are any more characters either sequence to read. If there are not any more characters to read, then the process 250 moves to a state 276 wherein the level of homology between the first and second sequences is displayed to the user. The level of homology is determined by calculating the proportion of characters between the sequences that were the same out of the total number of sequences in the first sequence. Thus, if every character in a first 100 nucleotide sequence aligned with an every character in a second sequence, the homology level would be 100%.

Alternatively, the computer program can compare a reference sequence to a sequence of the invention to determine whether the sequences differ at one or more positions. The program can record the length and identity of inserted, deleted or substituted nucleotides or amino acid residues with respect to the sequence of either the reference or the invention. The computer program may be a program which determines whether a reference sequence contains a single nucleotide polymorphism (SNP) with respect to a sequence of the invention, or, whether a sequence of the invention comprises a SNP of a known sequence. Thus, in some aspects, the computer program is a program which identifies SNPs. The method may be implemented by the computer systems described above and the method illustrated in FIG. 3. The method can be performed by reading a sequence of the invention and the reference sequences through the use of the computer program and identifying differences with the computer program.

Figure 4:
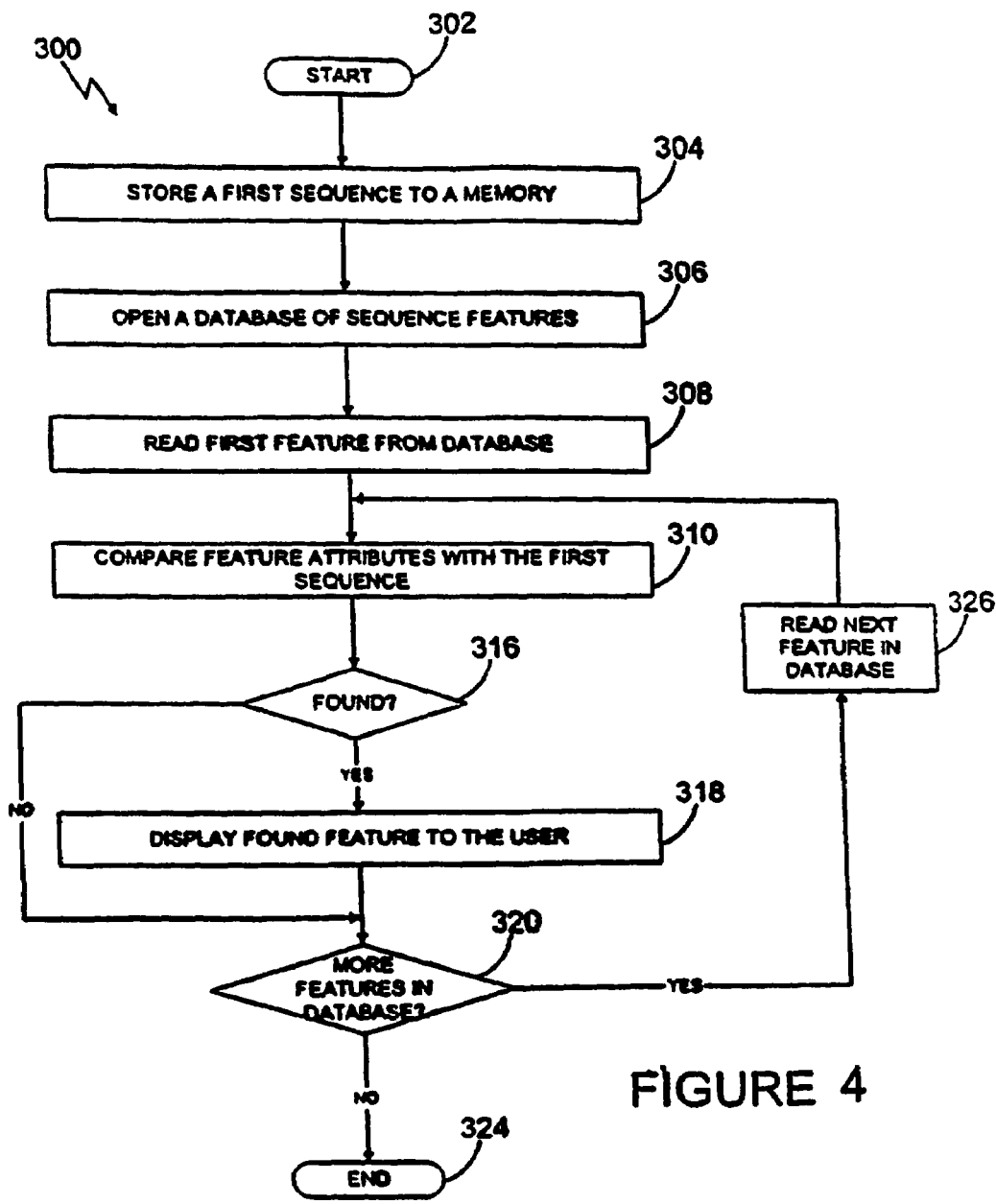
FIG. 4 is a flow diagram illustrating one aspect of an identifier process 300 for detecting the presence of a feature in a sequence.

In other aspects the computer based system comprises an identifier for identifying features within a nucleic acid or polypeptide of the invention. An "identifier" refers to one or more programs which identifies certain features within a nucleic acid sequence. For example, an identifier may comprise a program which identifies an open reading frame (ORF) in a nucleic acid sequence. FIG. 4 is a flow diagram illustrating one aspect of an identifier process 300 for detecting the presence of a feature in a sequence. The process 300 begins at a start state 302 and then moves to a state 304 wherein a first sequence that is to be checked for features is stored to a memory 115 in the computer system 100. The process 300 then moves to a state 306 wherein a database of sequence features is opened. Such a database would include a list of each feature's attributes along with the name of the feature. For example, a feature name could be "Initiation Codon" and the attribute would be "ATG". Another example would be the feature name "TAATAA Box" and the feature attribute would be "TAATAA". An example of such a database is produced by the University of Wisconsin Genetics Computer Group. Alternatively, the features may be structural polypeptide motifs such as alpha helices, beta sheets, or functional polypeptide motifs such as enzymatic active sites, helix-turn-helix motifs or other motifs known to those skilled in the art. Once the database of features is opened at the state 306, the process 300 moves to a state 308 wherein the first feature is read from the database. A comparison of the attribute of the first feature with the first sequence is then made at a state 310. A determination is then made at a decision state 316 whether the attribute of the feature was found in the first sequence. If the attribute was found, then the process 300 moves to a state 318 wherein the name of the found feature is displayed to the user. The process 300 then moves to a decision state 320 wherein a determination is made whether move features exist in the database. If no more features do exist, then the process 300 terminates at an end state 324. However, if more features do exist in the database, then the process 300 reads the next sequence feature at a state 326 and loops back to the state 310 wherein the attribute of the next feature is compared against the first sequence. If the feature attribute is not found in the first sequence at the decision state 316, the process 300 moves directly to the decision state 320 in order to determine if any more features exist in the database. Thus, in one aspect, the invention provides a computer program that identifies open reading frames (ORFs).

A polypeptide or nucleic acid sequence of the invention can be stored and manipulated in a variety of data processor programs in a variety of formats. For example, a sequence can be stored as text in a word processing file, such as Microsoft-WORD or WORDPERFECT or as an ASCII file in a variety of database programs familiar to those of skill in the art, such as DB2, SYBASE, or ORACLE. In addition, many computer programs and databases may be used as sequence comparison algorithms, identifiers, or sources of reference nucleotide sequences or polypeptide sequences to be compared to a nucleic acid sequence of the invention. The programs and databases used to practice the invention include, but are not limited to: MacPattern (EMBL), DiscoveryBase (Molecular Applications Group), GeneMine (Molecular Applications Group), Look (Molecular Applications Group), MacLook (Molecular Applications Group), BLAST and BLAST2 (NCBI), BLASTN and BLASTX (Altschul et al, J. Mol. Biol. 215: 403, 1990), FASTA (Pearson and Lipman, Proc. Natl. Acad. Sci. USA, 85: 2444, 1988), FASTDB (Brutlag et al. Comp. App. Biosci. 6:237-245, 1990), Catalyst (Molecular Simulations Inc.), Catalyst/SHAPE (Molecular Simulations Inc.), Cerius2.DBAccess (Molecular Simulations Inc.), HypoGen (Molecular Simulations Inc.), Insight II, (Molecular Simulations Inc.), Discover (Molecular Simulations Inc.), CHARMm (Molecular Simulations Inc.), Felix (Molecular Simulations Inc.), DelPhi, (Molecular Simulations Inc.), QuanteMM, (Molecular Simulations Inc.), Homology (Molecular Simulations Inc.), Modeler (Molecular Simulations Inc.), ISIS (Molecular Simulations Inc.), Quanta/Protein Design (Molecular Simulations Inc.), WebLab (Molecular Simulations Inc.), WebLab Diversity Explorer (Molecular Simulations Inc.), Gene Explorer (Molecular Simulations Inc.), SeqFold (Molecular Simulations Inc.), the MDL Available Chemicals Directory database, the MDL Drug Data Report data base, the Comprehensive Medicinal Chemistry database, Derwent's World Drug Index database, the BioByteMasterFile database, the Genbank database, and the Genseqn database. Many other programs and data bases would be apparent to one of skill in the art given the present disclosure.

Motifs which may be detected using the above programs include sequences encoding leucine zippers, helix-turn-helix motifs, glycosylation sites, ubiquitination sites, alpha helices, and beta sheets, signal sequences encoding signal peptides which direct the secretion of the encoded proteins, sequences implicated in transcription regulation such as homeoboxes, acidic stretches, enzymatic active sites, substrate binding sites, and enzymatic cleavage sites.

Hybridization of Nucleic Acids

The invention provides isolated or recombinant nucleic acids that hybridize under stringent conditions to an exemplary sequence of the invention (e.g., SEQ ID NO:1; SEQ ID NO:3; SEQ ID NO:5; SEQ ID NO:7; SEQ ID NO:9; SEQ ID NO:11; SEQ ID NO:13; SEQ ID NO:15; SEQ ID NO:17; SEQ ID NO:19; SEQ ID NO:21; SEQ ID NO:23; SEQ ID NO:25; SEQ ID NO:27; SEQ ID NO:29; SEQ ID NO:31; SEQ ID NO:33; SEQ ID NO:35; SEQ ID NO:37; SEQ ID NO:39; SEQ ID NO:41; SEQ ID NO:43; SEQ ID NO:45; SEQ ID NO:47; SEQ ID NO:49; SEQ ID NO:51; SEQ ID NO:53; SEQ ID NO:55; SEQ ID NO:57; SEQ ID NO:59; SEQ ID NO:61; SEQ ID NO:63; SEQ ID NO:65; SEQ ID NO:67; SEQ ID NO:69; SEQ ID NO:71; SEQ ID NO:73; SEQ ID NO:75; SEQ ID NO:77; SEQ ID NO:79; SEQ ID NO:81; SEQ ID NO:83; SEQ ID NO:85; SEQ ID NO:87; SEQ ID NO:89; SEQ ID NO:91; SEQ ID NO:93; SEQ ID NO:95; SEQ ID NO:97; SEQ ID NO:99; SEQ ID NO:101; SEQ ID NO:103; SEQ ID NO:105; SEQ ID NO:107; SEQ ID NO:109; SEQ ID NO:111; SEQ ID NO:113; SEQ ID NO:115; SEQ ID NO:117; SEQ ID NO:119; SEQ ID NO:121; SEQ ID NO:123; SEQ ID NO:125; SEQ ID NO:127; SEQ ID NO:129; SEQ ID NO:131; SEQ ID NO:133; SEQ ID NO:135; SEQ ID NO:137; SEQ ID NO:139; SEQ ID NO:141; SEQ ID NO:143; SEQ ID NO:145; SEQ ID NO:146; SEQ ID NO:150; SEQ ID NO:158; SEQ ID NO:164; SEQ ID NO:171; SEQ ID NO:179; SEQ ID NO:187; SEQ ID NO:193; SEQ ID NO:199; SEQ ID NO:204; SEQ ID NO:210; SEQ ID NO:218; SEQ ID NO:222; SEQ ID NO:229; SEQ ID NO:234; SEQ ID NO:241; SEQ ID NO:248 and/or SEQ ID NO:254), or a nucleic acid that encodes a polypeptide of the invention (e.g., SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132; SEQ ID NO:134; SEQ ID NO:136; SEQ ID NO:138; SEQ ID NO:140; SEQ ID NO:142; SEQ ID NO:144 and/or SEQ ID NO:147). The stringent conditions can be highly stringent conditions, medium stringent conditions and/or low stringent conditions, including the high and reduced stringency conditions described herein. In one aspect, it is the stringency of the wash conditions that set forth the conditions which determine whether a nucleic acid is within the scope of the invention, as discussed below.

In alternative embodiments, nucleic acids of the invention as defined by their ability to hybridize under stringent conditions can be between about five residues and the full length of nucleic acid of the invention; e.g., they can be at least 5, 10, 15, 20, 25, 30, 35, 40, 50, 55, 60, 65, 70, 75, 80, 90, 100, 150, 200, 250, 300, 350, 400, 450, 500, 550, 600, 650, 700, 750, 800, 850, 900, 950, 1000, or more, residues in length. Nucleic acids shorter than full length are also included. These nucleic acids can be useful as, e.g., hybridization probes, labeling probes, PCR oligonucleotide probes, iRNA (single or double stranded), antisense or sequences encoding antibody binding peptides (epitopes), motifs, active sites and the like.

In one aspect, nucleic acids of the invention are defined by their ability to hybridize under high stringency comprises conditions of about 50% formamide at about 37° C. to 42° C. In one aspect, nucleic acids of the invention are defined by their ability to hybridize under reduced stringency comprising conditions in about 35% to 25% formamide at about 30° C. to 35° C.

Alternatively, nucleic acids of the invention are defined by their ability to hybridize under high stringency comprising conditions at 42° C. in 50% formamide, 5×SSPE, 0.3% SDS, and a repetitive sequence blocking nucleic acid, such as cot-1 or salmon sperm DNA (e.g., 200 n/ml sheared and denatured salmon sperm DNA). In one aspect, nucleic acids of the invention are defined by their ability to hybridize under reduced stringency conditions comprising 35% formamide at a reduced temperature of 35° C.

Following hybridization, the filter may be washed with 6×SSC, 0.5% SDS at 50° C. These conditions are considered to be "moderate" conditions above 25% formamide and "low" conditions below 25% formamide. A specific example of "moderate" hybridization conditions is when the above hybridization is conducted at 30% formamide. A specific example of "low stringency" hybridization conditions is when the above hybridization is conducted at 10% formamide.

The temperature range corresponding to a particular level of stringency can be further narrowed by calculating the purine to pyrimidine ratio of the nucleic acid of interest and adjusting the temperature accordingly. Nucleic acids of the invention are also defined by their ability to hybridize under high, medium, and low stringency conditions as set forth in Ausubel and Sambrook. Variations on the above ranges and conditions are well known in the art. Hybridization conditions are discussed further, below.

The above procedure may be modified to identify nucleic acids having decreasing levels of homology to the probe sequence. For example, to obtain nucleic acids of decreasing homology to the detectable probe, less stringent conditions may be used. For example, the hybridization temperature may be decreased in increments of 5° C. from 68° C. to 42° C. in a hybridization buffer having a Na$^+$ concentration of approximately 1M. Following hybridization, the filter may be washed with 2×SSC, 0.5% SDS at the temperature of hybridization. These conditions are considered to be "moderate" conditions above 50° C. and "low" conditions below 50° C. A specific example of "moderate" hybridization conditions is when the above hybridization is conducted at 55° C. A specific example of "low stringency" hybridization conditions is when the above hybridization is conducted at 45° C.

Alternatively, the hybridization may be carried out in buffers, such as 6×SSC, containing formamide at a temperature of 42° C. In this case, the concentration of formamide in the hybridization buffer may be reduced in 5% increments from 50% to 0% to identify clones having decreasing levels of homology to the probe. Following hybridization, the filter may be washed with 6×SSC, 0.5% SDS at 50° C. These conditions are considered to be "moderate" conditions above 25% formamide and "low" conditions below 25% formamide. A specific example of "moderate" hybridization conditions is when the above hybridization is conducted at 30% formamide. A specific example of "low stringency" hybridization conditions is when the above hybridization is conducted at 10% formamide.

However, the selection of a hybridization format is not critical—it is the stringency of the wash conditions that set forth the conditions which determine whether a nucleic acid is within the scope of the invention. Wash conditions used to identify nucleic acids within the scope of the invention include, e.g.: a salt concentration of about 0.02 molar at pH 7 and a temperature of at least about 50° C. or about 55° C. to about 60° C.; or, a salt concentration of about 0.15 M NaCl at 72° C. for about 15 minutes; or, a salt concentration of about 0.2×SSC at a temperature of at least about 50° C. or about 55° C. to about 60° C. for about 15 to about 20 minutes; or, the hybridization complex is washed twice with a solution with a salt concentration of about 2×SSC containing 0.1% SDS at room temperature for 15 minutes and then washed twice by 0.1×SSC containing 0.1% SDS at 68° C. for 15 minutes; or, equivalent conditions. See Sambrook, Tijssen and Ausubel for a description of SSC buffer and equivalent conditions.

These methods may be used to isolate nucleic acids of the invention.

Oligonucleotides Probes and Methods for Using them

The invention also provides nucleic acid probes that can be used, e.g., for identifying nucleic acids encoding a polypeptide with a protease activity or fragments thereof or for identifying protease genes. In one aspect, the probe comprises at least 10 consecutive bases of a nucleic acid of the invention. Alternatively, a probe of the invention can be at least about 5, 6, 7, 8, 9, 10, 11, 12, 13, 14, 15, 16, 17, 18, 19, 20, 21, 22, 23, 24, 25, 30, 35, 40, 45, 50, 60, 70, 80, 90, 100, 110, 120, 130, 150 or about 10 to 50, about 20 to 60 about 30 to 70, consecutive bases of a sequence as set forth in a nucleic acid of the invention. The probes identify a nucleic acid by binding and/or hybridization. The probes can be used in arrays of the invention, see discussion below, including, e.g., capillary arrays. The probes of the invention can also be used to isolate other nucleic acids or polypeptides.

The probes of the invention can be used to determine whether a biological sample, such as a soil sample, contains an organism having a nucleic acid sequence of the invention or an organism from which the nucleic acid was obtained. In such procedures, a biological sample potentially harboring the organism from which the nucleic acid was isolated is obtained and nucleic acids are obtained from the sample. The nucleic acids are contacted with the probe under conditions which permit the probe to specifically hybridize to any complementary sequences present in the sample. Where necessary, conditions which permit the probe to specifically hybridize to complementary sequences may be determined by placing the probe in contact with complementary sequences from samples known to contain the complementary sequence, as well as control sequences which do not contain the complementary sequence. Hybridization conditions, such as the salt concentration of the hybridization buffer, the formamide concentration of the hybridization buffer, or the hybridization temperature, may be varied to identify conditions which allow the probe to hybridize specifically to complementary nucleic acids (see discussion on specific hybridization conditions).

If the sample contains the organism from which the nucleic acid was isolated, specific hybridization of the probe is then detected. Hybridization may be detected by labeling the probe with a detectable agent such as a radioactive isotope, a fluorescent dye or an enzyme capable of catalyzing the formation of a detectable product. Many methods for using the labeled probes to detect the presence of complementary nucleic acids in a sample are familiar to those skilled in the art. These include Southern Blots, Northern Blots, colony hybridization procedures, and dot blots. Protocols for each of these procedures are provided in Ausubel and Sambrook.

Alternatively, more than one probe (at least one of which is capable of specifically hybridizing to any complementary sequences which are present in the nucleic acid sample), may be used in an amplification reaction to determine whether the sample contains an organism containing a nucleic acid sequence of the invention (e.g., an organism from which the nucleic acid was isolated). In one aspect, the probes comprise oligonucleotides. In one aspect, the amplification reaction may comprise a PCR reaction. PCR protocols are described in Ausubel and Sambrook (see discussion on amplification reactions). In such procedures, the nucleic acids in the sample are contacted with the probes, the amplification reaction is performed, and any resulting amplification product is detected. The amplification product may be detected by performing gel electrophoresis on the reaction products and staining the gel with an intercalator such as ethidium bromide. Alternatively, one or more of the probes may be labeled with a radioactive isotope and the presence of a radioactive amplification product may be detected by autoradiography after gel electrophoresis.

Probes derived from sequences near the 3' or 5' ends of a nucleic acid sequence of the invention can also be used in chromosome walking procedures to identify clones containing additional, e.g., genomic sequences. Such methods allow the isolation of genes which encode additional proteins of interest from the host organism.

In one aspect, nucleic acid sequences of the invention are used as probes to identify and isolate related nucleic acids. In some aspects, the so-identified related nucleic acids may be cDNAs or genomic DNAs from organisms other than the one from which the nucleic acid of the invention was first isolated. In such procedures, a nucleic acid sample is contacted with the probe under conditions which permit the probe to specifically hybridize to related sequences. Hybridization of the probe to nucleic acids from the related organism is then detected using any of the methods described above.

In nucleic acid hybridization reactions, the conditions used to achieve a particular level of stringency can vary, depending on the nature of the nucleic acids being hybridized. For example, the length, degree of complementarity, nucleotide sequence composition (e.g., GC v. AT content), and nucleic acid type (e.g., RNA v. DNA) of the hybridizing regions of the nucleic acids can be considered in selecting hybridization conditions. An additional consideration is whether one of the nucleic acids is immobilized, for example, on a filter. Hybridization can be carried out under conditions of low stringency, moderate stringency or high stringency. As an example of nucleic acid hybridization, a polymer membrane containing immobilized denatured nucleic acids is first prehybridized for 30 minutes at 45° C. in a solution consisting of 0.9 M NaCl, 50 mM $NaH_2PO_4$, pH 7.0, 5.0 mM $Na_2EDTA$, 0.5% SDS, 10×Denhardt's, and 0.5 mg/ml polyriboadenylic acid. Approximately $2 \times 10^7$ cpm (specific activity $4-9 \times 10^8$ cpm/ug) of $^{32}P$ end-labeled oligonucleotide probe can then added to the solution. After 12-16 hours of incubation, the membrane is washed for 30 minutes at room temperature (RT) in 1×SET (150 mM NaCl, 20 mM Tris hydrochloride, pH 7.8, 1 mM $Na_2EDTA$) containing 0.5% SDS, followed by a 30 minute wash in fresh 1×SET at Tm-10° C. for the oligonucleotide probe. The membrane is then exposed to auto-radiographic film for detection of hybridization signals.

By varying the stringency of the hybridization conditions used to identify nucleic acids, such as cDNAs or genomic DNAs, which hybridize to the detectable probe, nucleic acids having different levels of homology to the probe can be identified and isolated. Stringency may be varied by conducting the hybridization at varying temperatures below the melting temperatures of the probes. The melting temperature, Tm, is the temperature (under defined ionic strength and pH) at which 50% of the target sequence hybridizes to a perfectly complementary probe. Very stringent conditions are selected to be equal to or about 5° C. lower than the Tm for a particular probe. The melting temperature of the probe may be calculated using the following exemplary formulas. For probes between 14 and 70 nucleotides in length the melting temperature (Tm) is calculated using the formula: Tm=81.5+16.6(log [Na+])+0.41(fraction G+C)−(600/N) where N is the length of the probe. If the hybridization is carried out in a solution containing formamide, the melting temperature may be calculated using the equation: Tm=81.5+16.6(log [Na+])+0.41 (fraction G+C)−(0.63% formamide)−(600/N) where N is the length of the probe. Prehybridization may be carried out in 6×SSC, 5×Denhardt's reagent, 0.5% SDS, 100 µg denatured fragmented salmon sperm DNA or 6×SSC, 5×Denhardt's reagent, 0.5% SDS, 100 µg denatured fragmented salmon sperm DNA, 50% formamide. Formulas for SSC and Denhardt's and other solutions are listed, e.g., in Sambrook.

Hybridization is conducted by adding the detectable probe to the prehybridization solutions listed above. Where the probe comprises double stranded DNA, it is denatured before addition to the hybridization solution. The filter is contacted with the hybridization solution for a sufficient period of time to allow the probe to hybridize to cDNAs or genomic DNAs containing sequences complementary thereto or homologous thereto. For probes over 200 nucleotides in length, the hybridization may be carried out at 15-25° C. below the Tm. For shorter probes, such as oligonucleotide probes, the hybridization may be conducted at 5-10° C. below the Tm. In one aspect, hybridizations in 6×SSC are conducted at approximately 68° C. In one aspect, hybridizations in 50% formamide containing solutions are conducted at approximately 42° C. All of the foregoing hybridizations would be considered to be under conditions of high stringency.

Following hybridization, the filter is washed to remove any non-specifically bound detectable probe. The stringency used to wash the filters can also be varied depending on the nature of the nucleic acids being hybridized, the length of the nucleic acids being hybridized, the degree of complementarity, the nucleotide sequence composition (e.g., GC v. AT content), and the nucleic acid type (e.g., RNA v. DNA). Examples of progressively higher stringency condition washes are as follows: 2×SSC, 0.1% SDS at room temperature for 15 minutes (low stringency); 0.1×SSC, 0.5% SDS at room temperature for 30 minutes to 1 hour (moderate stringency); 0.1×SSC, 0.5% SDS for 15 to 30 minutes at between the hybridization temperature and 68° C. (high stringency); and 0.15M NaCl for 15 minutes at 72° C. (very high stringency). A final low stringency wash can be conducted in 0.1×SSC at room temperature. The examples above are merely illustrative of one set of conditions that can be used to wash filters. One of skill in the art would know that there are numerous recipes for different stringency washes.

Nucleic acids which have hybridized to the probe can be identified by autoradiography or other conventional techniques. The above procedure may be modified to identify nucleic acids having decreasing levels of homology to the probe sequence. For example, to obtain nucleic acids of decreasing homology to the detectable probe, less stringent conditions may be used. For example, the hybridization temperature may be decreased in increments of 5° C. from 68° C. to 42° C. in a hybridization buffer having a Na+ concentration of approximately 1M. Following hybridization, the filter may be washed with 2×SSC, 0.5% SDS at the temperature of hybridization. These conditions are considered to be "moderate" conditions above 50° C. and "low" conditions below 50° C. An example of "moderate" hybridization conditions is when the above hybridization is conducted at 55° C. An example of "low stringency" hybridization conditions is when the above hybridization is conducted at 45° C.

Alternatively, the hybridization may be carried out in buffers, such as 6×SSC, containing formamide at a temperature of 42° C. In this case, the concentration of formamide in the hybridization buffer may be reduced in 5% increments from 50% to 0% to identify clones having decreasing levels of homology to the probe. Following hybridization, the filter may be washed with 6×SSC, 0.5% SDS at 50° C. These conditions are considered to be "moderate" conditions above 25% formamide and "low" conditions below 25% formamide. A specific example of "moderate" hybridization conditions is when the above hybridization is conducted at 30% formamide. A specific example of "low stringency" hybridization conditions is when the above hybridization is conducted at 10% formamide.

These probes and methods of the invention can be used to isolate nucleic acids having a sequence with at least about 99%, 98%, 97%, at least 95%, at least 90%, at least 85%, at least 80%, at least 75%, at least 70%, at least 65%, at least 60%, at least 55%, or at least 50% homology to a nucleic acid sequence of the invention comprising at least about 10, 15, 20, 25, 30, 35, 40, 50, 75, 100, 150, 200, 250, 300, 350, 400, 500, 550, 600, 650, 700, 750, 800, 850, 900, 950, 1000, or more consecutive bases thereof, and the sequences complementary thereto. Homology may be measured using an alignment algorithm, as discussed herein. For example, the homologous polynucleotides may have a coding sequence which is a naturally occurring allelic variant of one of the coding sequences described herein. Such allelic variants may have a substitution, deletion or addition of one or more nucleotides when compared to a nucleic acid of the invention.

Additionally, the probes and methods of the invention can be used to isolate nucleic acids which encode polypeptides having at least about 99%, at least 95%, at least 90%, at least 85%, at least 80%, at least 75%, at least 70%, at least 65%, at least 60%, at least 55%, or at least 50% sequence identity (homology) to a polypeptide of the invention comprising at least 5, 10, 15, 20, 25, 30, 35, 40, 50, 75, 100, or 150 consecutive amino acids, as determined using a sequence alignment algorithm (e.g., such as the FASTA version 3.0t78 algorithm with the default parameters, or a BLAST 2.2.2 program with exemplary settings as set forth herein).

Inhibiting Expression of Protease

The invention provides nucleic acids complementary to (e.g., antisense sequences to) the nucleic acids of the invention, e.g., protease-encoding nucleic acids. Antisense sequences are capable of inhibiting the transport, splicing or transcription of protease-encoding genes. The inhibition can be effected through the targeting of genomic DNA or messenger RNA. The transcription or function of targeted nucleic acid can be inhibited, for example, by hybridization and/or cleavage. One particularly useful set of inhibitors provided by the present invention includes oligonucleotides which are able to either bind protease gene or message, in either case preventing or inhibiting the production or function of protease. The association can be through sequence specific hybridization. Another useful class of inhibitors includes oligonucleotides which cause inactivation or cleavage of protease message. The oligonucleotide can have enzyme activity which causes such cleavage, such as ribozymes. The oligonucleotide can be chemically modified or conjugated to an enzyme or composition capable of cleaving the complementary nucleic acid. A pool of many different such oligonucleotides can be screened for those with the desired activity. Thus, the invention provides various compositions for the inhibition of protease expression on a nucleic acid and/or protein level, e.g., antisense, iRNA and ribozymes comprising protease sequences of the invention and the anti-protease antibodies of the invention.

Inhibition of protease expression can have a variety of industrial applications. For example, inhibition of protease expression can slow or prevent spoilage. Spoilage can occur when polypeptides, e.g., structural polypeptides, are enzymatically degraded. This can lead to the deterioration, or rot, of fruits and vegetables. In one aspect, use of compositions of the invention that inhibit the expression and/or activity of proteases, e.g., antibodies, antisense oligonucleotides, ribozymes and RNAi, are used to slow or prevent spoilage. Thus, in one aspect, the invention provides methods and compositions comprising application onto a plant or plant product (e.g., a fruit, seed, root, leaf, etc.) antibodies, antisense oligonucleotides, ribozymes and RNAi of the invention to slow or prevent spoilage. These compositions also can be expressed by the plant (e.g., a transgenic plant) or another organism (e.g., a bacterium or other microorganism transformed with a protease gene of the invention).

The compositions of the invention for the inhibition of protease expression (e.g., antisense, iRNA, ribozymes, antibodies) can be used as pharmaceutical compositions, e.g., as anti-pathogen agents or in other therapies, e.g., anti-inflammatory or skin or digestive aid treatments. For example, proteases are attractive antimalarial targets because of their indispensable roles in parasite infection and development, especially in the processes of host erythrocyte rupture, invasion and hemoglobin degradation; see, e.g., Wu (2003) Genome Res. 13:601-616. Selective inhibition of the mosquito angiotensin-converting enzyme (ACE) (a dipeptidyl carboxypeptidase) involved in the activation/inactivation of a peptide regulating egg-laying activity can be an effective anti-mosquito method; see, e.g., Ekbote (2003) Comp. Biochem. Physiol. B. Biochem. Mol. Biol. 134:593-598. Inhibition of matrix metalloproteases (e.g., metalloproteinases) and collagenases, which can degrade extracellular matrices and promote cancer cell migration and metastases, can be used to treat or ameliorate these conditions; see e.g., Elnemr (2003) Gastric Cancer 6:30-38.

Antisense Oligonucleotides

The invention provides antisense oligonucleotides capable of binding protease message which can inhibit proteolytic activity by targeting mRNA. Strategies for designing antisense oligonucleotides are well described in the scientific and patent literature, and the skilled artisan can design such protease oligonucleotides using the novel reagents of the invention. For example, gene walking/RNA mapping protocols to screen for effective antisense oligonucleotides are well known in the art, see, e.g., Ho (2000) Methods Enzymol. 314:168-183, describing an RNA mapping assay, which is based on standard molecular techniques to provide an easy and reliable method for potent antisense sequence selection. See also Smith (2000) Eur. J. Pharm. Sci. 11:191-198.

Naturally occurring nucleic acids are used as antisense oligonucleotides. The antisense oligonucleotides can be of any length; for example, in alternative aspects, the antisense oligonucleotides are between about 5 to 100, about 10 to 80, about 15 to 60, about 18 to 40. The optimal length can be determined by routine screening. The antisense oligonucleotides can be present at any concentration. The optimal concentration can be determined by routine screening. A wide variety of synthetic, non-naturally occurring nucleotide and nucleic acid analogues are known which can address this potential problem. For example, peptide nucleic acids (PNAs) containing non-ionic backbones, such as N-(2-aminoethyl) glycine units can be used. Antisense oligonucleotides having phosphorothioate linkages can also be used, as described in WO 97/03211; WO 96/39154; Mata (1997) Toxicol Appl Pharmacol 144:189-197; Antisense Therapeutics, ed. Agrawal (Humana Press, Totowa, N.J., 1996). Antisense oligonucleotides having synthetic DNA backbone analogues provided by the invention can also include phosphorodithioate, methylphosphonate, phosphoramidate, alkyl phosphotriester, sulfamate, 3'-thioacetal, methylene(methylimino), 3'-N-carbamate, and morpholino carbamate nucleic acids, as described above.

Combinatorial chemistry methodology can be used to create vast numbers of oligonucleotides that can be rapidly screened for specific oligonucleotides that have appropriate binding affinities and specificities toward any target, such as the sense and antisense protease sequences of the invention (see, e.g., Gold (1995) J. of Biol. Chem. 270:13581-13584).

Inhibitory Ribozymes

The invention provides ribozymes capable of binding protease message. These ribozymes can inhibit protease activity by, e.g., targeting mRNA. Strategies for designing ribozymes and selecting the protease-specific antisense sequence for targeting are well described in the scientific and patent literature, and the skilled artisan can design such ribozymes using the novel reagents of the invention. Ribozymes act by binding to a target RNA through the target RNA binding portion of a ribozyme which is held in close proximity to an enzymatic portion of the RNA that cleaves the target RNA. Thus, the ribozyme recognizes and binds a target RNA through complementary base-pairing, and once bound to the correct site, acts enzymatically to cleave and inactivate the target RNA. Cleavage of a target RNA in such a manner will destroy its ability to direct synthesis of an encoded protein if the cleavage occurs in the coding sequence. After a ribozyme has bound and cleaved its RNA target, it can be released from that RNA to bind and cleave new targets repeatedly.

In some circumstances, the enzymatic nature of a ribozyme can be advantageous over other technologies, such as antisense technology (where a nucleic acid molecule simply binds to a nucleic acid target to block its transcription, translation or association with another molecule) as the effective concentration of ribozyme necessary to effect a therapeutic treatment can be lower than that of an antisense oligonucleotide. This potential advantage reflects the ability of the ribozyme to act enzymatically. Thus, a single ribozyme molecule is able to cleave many molecules of target RNA. In addition, a ribozyme is typically a highly specific inhibitor, with the specificity of inhibition depending not only on the base pairing mechanism of binding, but also on the mechanism by which the molecule inhibits the expression of the RNA to which it binds. That is, the inhibition is caused by cleavage of the RNA target and so specificity is defined as the ratio of the rate of cleavage of the targeted RNA over the rate of cleavage of non-targeted RNA. This cleavage mechanism is dependent upon factors additional to those involved in base pairing. Thus, the specificity of action of a ribozyme can be greater than that of antisense oligonucleotide binding the same RNA site.

The ribozyme of the invention, e.g., an enzymatic ribozyme RNA molecule, can be formed in a hammerhead motif, a hairpin motif, as a hepatitis delta virus motif, a group I intron motif and/or an RNaseP-like RNA in association with an RNA guide sequence. Examples of hammerhead motifs are described by, e.g., Rossi (1992) Aids Research and Human Retroviruses 8:183; hairpin motifs by Hampel (1989) Biochemistry 28:4929, and Hampel (1990) Nuc. Acids Res. 18:299; the hepatitis delta virus motif by Perrotta (1992) Biochemistry 31:16; the RNaseP motif by Guerrier-Takada (1983) Cell 35:849; and the group I intron by Cech U.S. Pat. No. 4,987,071. The recitation of these specific motifs is not intended to be limiting. Those skilled in the art will recognize that a ribozyme of the invention, e.g., an enzymatic RNA molecule of this invention, can have a specific substrate binding site complementary to one or more of the target gene RNA regions. A ribozyme of the invention can have a nucleotide sequence within or surrounding that substrate binding site which imparts an RNA cleaving activity to the molecule.

RNA Interference (RNAi)

In one aspect, the invention provides an RNA inhibitory molecule, a so-called "RNAi" molecule, comprising a protease sequence of the invention. The RNAi molecule comprises a double-stranded RNA (dsRNA) molecule. The RNAi can inhibit expression of a protease gene. In one aspect, the RNAi is about 15, 16, 17, 18, 19, 20, 21, 22, 23, 24, 25 or more duplex nucleotides in length. While the invention is not limited by any particular mechanism of action, the RNAi can enter a cell and cause the degradation of a single-stranded RNA (ssRNA) of similar or identical sequences, including endogenous mRNAs. When a cell is exposed to double-stranded RNA (dsRNA), mRNA from the homologous gene is selectively degraded by a process called RNA interference (RNAi). A possible basic mechanism behind RNAi is the breaking of a double-stranded RNA (dsRNA) matching a specific gene sequence into short pieces called short interfering RNA, which trigger the degradation of mRNA that matches its sequence. In one aspect, the RNAi's of the invention are used in gene-silencing therapeutics, see, e.g., Shuey (2002) Drug Discov. Today 7:1040-1046. In one aspect, the invention provides methods to selectively degrade RNA using the RNAi's of the invention. The process may be practiced in vitro, ex vivo or in vivo. In one aspect, the RNAi molecules of the invention can be used to generate a loss-of-function mutation in a cell, an organ or an animal. Methods for making and using RNAi molecules for selectively degrade RNA are well known in the art, see, e.g., U.S. Pat. Nos. 6,506,559; 6,511,824; 6,515,109; 6,489,127.

Modification of Nucleic Acids

The invention provides methods of generating variants of the nucleic acids of the invention, e.g., those encoding a protease. These methods can be repeated or used in various combinations to generate proteases having an altered or different activity or an altered or different stability from that of a protease encoded by the template nucleic acid. These methods also can be repeated or used in various combinations, e.g., to generate variations in gene/message expression, message translation or message stability. In another aspect, the genetic composition of a cell is altered by, e.g., modification of a homologous gene ex vivo, followed by its reinsertion into the cell.

A nucleic acid of the invention can be altered by any means. For example, random or stochastic methods, or, non-stochastic, or "directed evolution," methods, see, e.g., U.S. Pat. No. 6,361,974. Methods for random mutation of genes are well known in the art, see, e.g., U.S. Pat. No. 5,830,696. For example, mutagens can be used to randomly mutate a gene. Mutagens include, e.g., ultraviolet light or gamma irradiation, or a chemical mutagen, e.g., mitomycin, nitrous acid, photoactivated psoralens, alone or in combination, to induce DNA breaks amenable to repair by recombination. Other chemical mutagens include, for example, sodium bisulfite, nitrous acid, hydroxylamine, hydrazine or formic acid. Other mutagens are analogues of nucleotide precursors, e.g., nitrosoguanidine, 5-bromouracil, 2-aminopurine, or acridine. These agents can be added to a PCR reaction in place of the nucleotide precursor thereby mutating the sequence. Intercalating agents such as proflavine, acriflavine, quinacrine and the like can also be used.

Any technique in molecular biology can be used, e.g., random PCR mutagenesis, see, e.g., Rice (1992) Proc. Natl. Acad. Sci. USA 89:5467-5471; or, combinatorial multiple cassette mutagenesis, see, e.g., Crameri (1995) Biotechniques 18:194-196. Alternatively, nucleic acids, e.g., genes, can be reassembled after random, or "stochastic," fragmentation, see, e.g., U.S. Pat. Nos. 6,291,242; 6,287,862; 6,287,861; 5,955,358; 5,830,721; 5,824,514; 5,811,238; 5,605,793. In alternative aspects, modifications, additions or deletions are introduced by error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, gene site saturated mutagenesis (GSSM), synthetic ligation reassembly (SLR), recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation, and/or a combination of these and other methods.

The following publications describe a variety of recursive recombination procedures and/or methods which can be incorporated into the methods of the invention: Stemmer (1999) "Molecular breeding of viruses for targeting and other clinical properties" Tumor Targeting 4:1-4; Ness (1999) Nature Biotechnology 17:893-896; Chang (1999) "Evolution of a cytokine using DNA family shuffling" Nature Biotechnology 17:793-797; Minshull (1999) "Protein evolution by molecular breeding" Current Opinion in Chemical Biology 3:284-290; Christians (1999) "Directed evolution of thymidine kinase for AZT phosphorylation using DNA family shuffling" Nature Biotechnology 17:259-264; Crameri (1998) "DNA shuffling of a family of genes from diverse species accelerates directed evolution" Nature 391:288-291; Crameri (1997) "Molecular evolution of an arsenate detoxification pathway by DNA shuffling," Nature Biotechnology 15:436-438; Zhang (1997) "Directed evolution of an effective fucosidase from a galactosidase by DNA shuffling and screening" Proc. Natl. Acad. Sci. USA 94:4504-4509; Patten et al. (1997) "Applications of DNA Shuffling to Pharmaceuticals and Vaccines" Current Opinion in Biotechnology 8:724-733; Crameri et al. (1996) "Construction and evolution of antibody-phage libraries by DNA shuffling" Nature Medicine 2:100-103; Gates et al. (1996) "Affinity selective isolation of ligands from peptide libraries through display on a lac repressor 'headpiece dimer' " Journal of Molecular Biology 255: 373-386; Stemmer (1996) "Sexual PCR and Assembly PCR" In: The Encyclopedia of Molecular Biology. VCH Publishers, New York. pp. 447-457; Crameri and Stemmer (1995) "Combinatorial multiple cassette mutagenesis creates all the permutations of mutant and wildtype cassettes" BioTechniques 18:194-195; Stemmer et al. (1995) "Single-step assembly of a gene and entire plasmid form large numbers of oligodeoxyribonucleotides" Gene, 164:49-53; Stemmer (1995) "The Evolution of Molecular Computation" Science 270:1510; Stemmer (1995) "Searching Sequence Space" Bio/Technology 13:549-553; Stemmer (1994) "Rapid evolution of a protein in vitro by DNA shuffling" Nature 370:389-391; and Stemmer (1994) "DNA shuffling by random fragmentation and reassembly: In vitro recombination for molecular evolution." Proc. Natl. Acad. Sci. USA 91:10747-10751.

Mutational methods of generating diversity include, for example, site-directed mutagenesis (Ling et al. (1997) "Approaches to DNA mutagenesis: an overview" Anal Biochem. 254(2): 157-178; Dale et al. (1996) "Oligonucleotide-directed random mutagenesis using the phosphorothioate method" Methods Mol. Biol. 57:369-374; Smith (1985) "In vitro mutagenesis" Ann. Rev. Genet. 19:423-462; Botstein & Shortle (1985) "Strategies and applications of in vitro mutagenesis" Science 229:1193-1201; Carter (1986) "Site-directed mutagenesis" Biochem. J. 237:1-7; and Kunkel (1987) "The efficiency of oligonucleotide directed mutagenesis" in Nucleic Acids & Molecular Biology (Eckstein, F. and Lilley, D. M. J. eds., Springer Verlag, Berlin)); mutagenesis using uracil containing templates (Kunkel (1985) "Rapid and efficient site-specific mutagenesis without phenotypic selection" Proc. Natl. Acad. Sci. USA 82:488-492; Kunkel et al. (1987) "Rapid and efficient site-specific mutagenesis without phenotypic selection" Methods in Enzymol. 154, 367-382; and Bass et al. (1988) "Mutant Trp repressors with new DNA-binding specificities" Science 242:240-245); oligonucleotide-directed mutagenesis (Methods in Enzymol. 100: 468-500 (1983); Methods in Enzymol. 154: 329-350 (1987); Zoller (1982) "Oligonucleotide-directed mutagenesis using M13-derived vectors: an efficient and general procedure for the production of point mutations in any DNA fragment" Nucleic Acids Res. 10:6487-6500; Zoller & Smith (1983) "Oligonucleotide-directed mutagenesis of DNA fragments cloned into M13 vectors" Methods in Enzymol. 100:468-500; and Zoller (1987) Oligonucleotide-directed mutagenesis: a simple method using two oligonucleotide primers and a single-stranded DNA template" Methods in Enzymol. 154: 329-350); phosphorothioate-modified DNA mutagenesis (Taylor (1985) "The use of phosphorothioate-modified DNA in restriction enzyme reactions to prepare nicked DNA" Nucl. Acids Res. 13: 8749-8764; Taylor (1985) "The rapid generation of oligonucleotide-directed mutations at high frequency using phosphorothioate-modified DNA" Nucl. Acids Res. 13: 8765-8787 (1985); Nakamaye (1986) "Inhibition of restriction endonuclease Nci I cleavage by phosphorothioate groups and its application to oligonucleotide-directed mutagenesis" Nucl. Acids Res. 14: 9679-9698; Sayers (1988) "Y-T Exonucleases in phosphorothioate-based oligonucleotide-directed mutagenesis" Nucl. Acids Res. 16:791-802; and Sayers et al. (1988) "Strand specific cleavage of phosphorothioate-containing DNA by reaction with restriction endonucleases in the presence of ethidium bromide" Nucl. Acids Res. 16: 803-814); mutagenesis using gapped duplex DNA (Kramer et al. (1984) "The gapped duplex DNA approach to oligonucleotide-directed mutation construction" Nucl. Acids Res. 12: 9441-9456; Kramer & Fritz (1987) Methods in Enzymol.

"Oligonucleotide-directed construction of mutations via gapped duplex DNA" 154:350-367; Kramer (1988) "Improved enzymatic in vitro reactions in the gapped duplex DNA approach to oligonucleotide-directed construction of mutations" Nucl. Acids Res. 16: 7207; and Fritz (1988) "Oligonucleotide-directed construction of mutations: a gapped duplex DNA procedure without enzymatic reactions in vitro" Nucl. Acids Res. 16: 6987-6999).

Additional protocols that can be used to practice the invention include point mismatch repair (Kramer (1984) "Point Mismatch Repair" Cell 38:879-887), mutagenesis using repair-deficient host strains (Carter et al. (1985) "Improved oligonucleotide site-directed mutagenesis using M13 vectors" Nucl. Acids Res. 13: 4431-4443; and Carter (1987) "Improved oligonucleotide-directed mutagenesis using M13 vectors" Methods in Enzymol. 154: 382-403), deletion mutagenesis (Eghtedarzadeh (1986) "Use of oligonucleotides to generate large deletions" Nucl. Acids Res. 14: 5115), restriction-selection and restriction-selection and restriction-purification (Wells et al. (1986) "Importance of hydrogen-bond formation in stabilizing the transition state of subtilisin" Phil. Trans. R. Soc. Lond. A 317: 415-423), mutagenesis by total gene synthesis (Nambiar et al. (1984) "Total synthesis and cloning of a gene coding for the ribonuclease S protein" Science 223: 1299-1301; Sakamar and Khorana (1988) "Total synthesis and expression of a gene for the a-subunit of bovine rod outer segment guanine nucleotide-binding protein (transducin)" Nucl. Acids Res. 14: 6361-6372; Wells et al. (1985) "Cassette mutagenesis: an efficient method for generation of multiple mutations at defined sites" Gene 34:315-323; and Grundstrom et al. (1985) "Oligonucleotide-directed mutagenesis by microscale 'shotgun' gene synthesis" Nucl. Acids Res. 13: 3305-3316), double-strand break repair (Mandecki (1986); Arnold (1993) "Protein engineering for unusual environments" Current Opinion in Biotechnology 4:450-455. "Oligonucleotide-directed double-strand break repair in plasmids of Escherichia coli: a method for site-specific mutagenesis" Proc. Natl. Acad. Sci. USA, 83:7177-7181). Additional details on many of the above methods can be found in Methods in Enzymology Volume 154, which also describes useful controls for trouble-shooting problems with various mutagenesis methods.

Protocols that can be used to practice the invention are described, e.g., in U.S. Pat. No. 5,605,793 to Stemmer (Feb. 25, 1997), "Methods for In Vitro Recombination;" U.S. Pat. No. 5,811,238 to Stemmer et al. (Sep. 22, 1998) "Methods for Generating Polynucleotides having Desired Characteristics by Iterative Selection and Recombination;" U.S. Pat. No. 5,830,721 to Stemmer et al. (Nov. 3, 1998), "DNA Mutagenesis by Random Fragmentation and Reassembly;" U.S. Pat. No. 5,834,252 to Stemmer, et al. (Nov. 10, 1998) "End-Complementary Polymerase Reaction;" U.S. Pat. No. 5,837,458 to Minshull, et al. (Nov. 17, 1998), "Methods and Compositions for Cellular and Metabolic Engineering;" WO 95/22625, Stemmer and Crameri, "Mutagenesis by Random Fragmentation and Reassembly;" WO 96/33207 by Stemmer and Lipschutz "End Complementary Polymerase Chain Reaction;" WO 97/20078 by Stemmer and Crameri "Methods for Generating Polynucleotides having Desired Characteristics by Iterative Selection and Recombination;" WO 97/35966 by Minshull and Stemmer, "Methods and Compositions for Cellular and Metabolic Engineering;" WO 99/41402 by Punnonen et al. "Targeting of Genetic Vaccine Vectors;" WO 99/41383 by Punnonen et al. "Antigen Library Immunization;" WO 99/41369 by Punnonen et al. "Genetic Vaccine Vector Engineering;" WO 99/41368 by Punnonen et al. "Optimization of Immunomodulatory Properties of Genetic Vaccines;" EP 752008 by Stemmer and Crameri, "DNA Mutagenesis by Random Fragmentation and Reassembly;" EP 0932670 by Stemmer "Evolving Cellular DNA Uptake by Recursive Sequence Recombination;" WO 99/23107 by Stemmer et al., "Modification of Virus Tropism and Host Range by Viral Genome Shuffling;" WO 99/21979 by Apt et al., "Human Papillomavirus Vectors;" WO 98/31837 by del Cardayre et al. "Evolution of Whole Cells and Organisms by Recursive Sequence Recombination;" WO 98/27230 by Patten and Stemmer, "Methods and Compositions for Polypeptide Engineering;" WO 98/27230 by Stemmer et al., "Methods for Optimization of Gene Therapy by Recursive Sequence Shuffling and Selection," WO 00/00632, "Methods for Generating Highly Diverse Libraries," WO 00/09679, "Methods for Obtaining in Vitro Recombined Polynucleotide Sequence Banks and Resulting Sequences," WO 98/42832 by Arnold et al., "Recombination of Polynucleotide Sequences Using Random or Defined Primers," WO 99/29902 by Arnold et al., "Method for Creating Polynucleotide and Polypeptide Sequences," WO 98/41653 by Vind, "An in Vitro Method for Construction of a DNA Library," WO 98/41622 by Borchert et al., "Method for Constructing a Library Using DNA Shuffling," and WO 98/42727 by Pati and Zarling, "Sequence Alterations using Homologous Recombination."

Protocols that can be used to practice the invention (providing details regarding various diversity generating methods) are described, e.g., in U.S. patent application Ser. No. 09/407,800, "SHUFFLING OF CODON ALTERED GENES" by Patten et al. filed Sep. 28, 1999; "EVOLUTION OF WHOLE CELLS AND ORGANISMS BY RECURSIVE SEQUENCE RECOMBINATION" by del Cardayre et al., U.S. Pat. No. 6,379,964; "OLIGONUCLEOTIDE MEDIATED NUCLEIC ACID RECOMBINATION" by Crameri et al., U.S. Pat. Nos. 6,319,714; 6,368,861; 6,376,246; 6,423,542; 6,426,224 and PCT/US00/01203; "USE OF CODON-VARIED OLIGONUCLEOTIDE SYNTHESIS FOR SYNTHETIC SHUFFLING" by Welch et al., U.S. Pat. No. 6,436,675; "METHODS FOR MAKING CHARACTER STRINGS, POLYNUCLEOTIDES & POLYPEPTIDES HAVING DESIRED CHARACTERISTICS" by Selifonov et al., filed Jan. 18, 2000, (PCT/US00/01202) and, e.g. "METHODS FOR MAKING CHARACTER STRINGS, POLYNUCLEOTIDES & POLYPEPTIDES HAVING DESIRED CHARACTERISTICS" by Selifonov et al., filed Jul. 18, 2000 (U.S. Ser. No. 09/618,579); "METHODS OF POPULATING DATA STRUCTURES FOR USE IN EVOLUTIONARY SIMULATIONS" by Selifonov and Stemmer, filed Jan. 18, 2000 (PCT/US00/01138); and "SINGLE-STRANDED NUCLEIC ACID TEMPLATE-MEDIATED RECOMBINATION AND NUCLEIC ACID FRAGMENT ISOLATION" by Affholter, filed Sep. 6, 2000 (U.S. Ser. No. 09/656,549); and U.S. Pat. Nos. 6,177,263; 6,153,410.

Non-stochastic, or "directed evolution," methods include, e.g., saturation mutagenesis (GSSM), synthetic ligation reassembly (SLR), or a combination thereof are used to modify the nucleic acids of the invention to generate proteases with new or altered properties (e.g., activity under highly acidic or alkaline conditions, high or low temperatures, and the like). Polypeptides encoded by the modified nucleic acids can be screened for an activity before testing for proteolytic or other activity. Any testing modality or protocol can be used, e.g., using a capillary array platform. See, e.g., U.S. Pat. Nos. 6,361,974; 6,280,926; 5,939,250.

Saturation Mutagenesis, or, GSSM

In one aspect, codon primers containing a degenerate N,N,G/T sequence are used to introduce point mutations into a polynucleotide, e.g., a protease or an antibody of the invention, so as to generate a set of progeny polypeptides in which a full range of single amino acid substitutions is represented at each amino acid position, e.g., an amino acid residue in an enzyme active site or ligand binding site targeted to be modified. These oligonucleotides can comprise a contiguous first homologous sequence, a degenerate N,N,G/T sequence, and, optionally, a second homologous sequence. The downstream progeny translational products from the use of such oligonucleotides include all possible amino acid changes at each amino acid site along the polypeptide, because the degeneracy of the N,N,G/T sequence includes codons for all 20 amino acids. In one aspect, one such degenerate oligonucleotide (comprised of, e.g., one degenerate N,N,G/T cassette) is used for subjecting each original codon in a parental polynucleotide template to a full range of codon substitutions. In another aspect, at least two degenerate cassettes are used—either in the same oligonucleotide or not, for subjecting at least two original codons in a parental polynucleotide template to a full range of codon substitutions. For example, more than one N,N,G/T sequence can be contained in one oligonucleotide to introduce amino acid mutations at more than one site. This plurality of N,N,G/T sequences can be directly contiguous, or separated by one or more additional nucleotide sequence(s). In another aspect, oligonucleotides serviceable for introducing additions and deletions can be used either alone or in combination with the codons containing an N,N,G/T sequence, to introduce any combination or permutation of amino acid additions, deletions, and/or substitutions.

In one aspect, simultaneous mutagenesis of two or more contiguous amino acid positions is done using an oligonucleotide that contains contiguous N,N,G/T triplets, i.e. a degenerate (N,N,G/T)n sequence. In another aspect, degenerate cassettes having less degeneracy than the N,N,G/T sequence are used. For example, it may be desirable in some instances to use (e.g. in an oligonucleotide) a degenerate triplet sequence comprised of only one N, where said N can be in the first second or third position of the triplet. Any other bases including any combinations and permutations thereof can be used in the remaining two positions of the triplet. Alternatively, it may be desirable in some instances to use (e.g. in an oligo) a degenerate N,N,N triplet sequence.

In one aspect, use of degenerate triplets (e.g., N,N,G/T triplets) allows for systematic and easy generation of a full range of possible natural amino acids (for a total of 20 amino acids) into each and every amino acid position in a polypeptide (in alternative aspects, the methods also include generation of less than all possible substitutions per amino acid residue, or codon, position). For example, for a 100 amino acid polypeptide, 2000 distinct species (i.e. 20 possible amino acids per position×100 amino acid positions) can be generated. Through the use of an oligonucleotide or set of oligonucleotides containing a degenerate N,N,G/T triplet, 32 individual sequences can code for all 20 possible natural amino acids. Thus, in a reaction vessel in which a parental polynucleotide sequence is subjected to saturation mutagenesis using at least one such oligonucleotide, there are generated 32 distinct progeny polynucleotides encoding 20 distinct polypeptides. In contrast, the use of a non-degenerate oligonucleotide in site-directed mutagenesis leads to only one progeny polypeptide product per reaction vessel. Nondegenerate oligonucleotides can optionally be used in combination with degenerate primers disclosed; for example, nondegenerate oligonucleotides can be used to generate specific point mutations in a working polynucleotide. This provides one means to generate specific silent point mutations, point mutations leading to corresponding amino acid changes, and point mutations that cause the generation of stop codons and the corresponding expression of polypeptide fragments.

In one aspect, each saturation mutagenesis reaction vessel contains polynucleotides encoding at least 20 progeny polypeptide (e.g., proteases) molecules such that all 20 natural amino acids are represented at the one specific amino acid position corresponding to the codon position mutagenized in the parental polynucleotide (other aspects use less than all 20 natural combinations). The 32-fold degenerate progeny polypeptides generated from each saturation mutagenesis reaction vessel can be subjected to clonal amplification (e.g. cloned into a suitable host, e.g., $E.\ coli$ host, using, e.g., an expression vector) and subjected to expression screening. When an individual progeny polypeptide is identified by screening to display a favorable change in property (when compared to the parental polypeptide, such as increased proteolytic activity under alkaline or acidic conditions), it can be sequenced to identify the correspondingly favorable amino acid substitution contained therein.

In one aspect, upon mutagenizing each and every amino acid position in a parental polypeptide using saturation mutagenesis as disclosed herein, favorable amino acid changes may be identified at more than one amino acid position. One or more new progeny molecules can be generated that contain a combination of all or part of these favorable amino acid substitutions. For example, if 2 specific favorable amino acid changes are identified in each of 3 amino acid positions in a polypeptide, the permutations include 3 possibilities at each position (no change from the original amino acid, and each of two favorable changes) and 3 positions. Thus, there are 3×3×3 or 27 total possibilities, including 7 that were previously examined—6 single point mutations (i.e. 2 at each of three positions) and no change at any position.

In another aspect, site-saturation mutagenesis can be used together with another stochastic or non-stochastic means to vary sequence, e.g., synthetic ligation reassembly (see below), shuffling, chimerization, recombination and other mutagenizing processes and mutagenizing agents. This invention provides for the use of any mutagenizing process(es), including saturation mutagenesis, in an iterative manner.

Synthetic Ligation Reassembly (SLR)

The invention provides a non-stochastic gene modification system termed "synthetic ligation reassembly," or simply "SLR," a "directed evolution process," to generate polypeptides, e.g., proteases or antibodies of the invention, with new or altered properties. SLR is a method of ligating oligonucleotide fragments together non-stochastically. This method differs from stochastic oligonucleotide shuffling in that the nucleic acid building blocks are not shuffled, concatenated or chimerized randomly, but rather are assembled non-stochastically. See, e.g., U.S. patent application Ser. No. 09/332,835 entitled "Synthetic Ligation Reassembly in Directed Evolution" and filed on Jun. 14, 1999 ("U.S. Ser. No. 09/332,835"). In one aspect, SLR comprises the following steps: (a) providing a template polynucleotide, wherein the template polynucleotide comprises sequence encoding a homologous gene; (b) providing a plurality of building block polynucleotides, wherein the building block polynucleotides are designed to cross-over reassemble with the template polynucleotide at a predetermined sequence, and a building block polynucleotide comprises a sequence that is a variant of the homologous gene and a sequence homologous to the template polynucleotide flanking the variant sequence; (c) combining a building block polynucleotide with a template polynucleotide such that the building block polynucleotide cross-over reassembles with the template polynucleotide to generate polynucleotides comprising homologous gene sequence variations.

SLR does not depend on the presence of high levels of homology between polynucleotides to be rearranged. Thus, this method can be used to non-stochastically generate libraries (or sets) of progeny molecules comprised of over 10100 different chimeras. SLR can be used to generate libraries comprised of over 101000 different progeny chimeras. Thus, aspects of the present invention include non-stochastic methods of producing a set of finalized chimeric nucleic acid molecule shaving an overall assembly order that is chosen by design. This method includes the steps of generating by design a plurality of specific nucleic acid building blocks having serviceable mutually compatible ligatable ends, and assembling these nucleic acid building blocks, such that a designed overall assembly order is achieved.

The mutually compatible ligatable ends of the nucleic acid building blocks to be assembled are considered to be "serviceable" for this type of ordered assembly if they enable the building blocks to be coupled in predetermined orders. Thus, the overall assembly order in which the nucleic acid building blocks can be coupled is specified by the design of the ligatable ends. If more than one assembly step is to be used, then the overall assembly order in which the nucleic acid building blocks can be coupled is also specified by the sequential order of the assembly step(s). In one aspect, the annealed building pieces are treated with an enzyme, such as a ligase (e.g. T4 DNA ligase), to achieve covalent bonding of the building pieces.

In one aspect, the design of the oligonucleotide building blocks is obtained by analyzing a set of progenitor nucleic acid sequence templates that serve as a basis for producing a progeny set of finalized chimeric polynucleotides. These parental oligonucleotide templates thus serve as a source of sequence information that aids in the design of the nucleic acid building blocks that are to be mutagenized, e.g., chimerized or shuffled. In one aspect of this method, the sequences of a plurality of parental nucleic acid templates are aligned in order to select one or more demarcation points. The demarcation points can be located at an area of homology, and are comprised of one or more nucleotides. These demarcation points are preferably shared by at least two of the progenitor templates. The demarcation points can thereby be used to delineate the boundaries of oligonucleotide building blocks to be generated in order to rearrange the parental polynucleotides. The demarcation points identified and selected in the progenitor molecules serve as potential chimerization points in the assembly of the final chimeric progeny molecules. A demarcation point can be an area of homology (comprised of at least one homologous nucleotide base) shared by at least two parental polynucleotide sequences. Alternatively, a demarcation point can be an area of homology that is shared by at least half of the parental polynucleotide sequences, or, it can be an area of homology that is shared by at least two thirds of the parental polynucleotide sequences. Even more preferably a serviceable demarcation points is an area of homology that is shared by at least three fourths of the parental polynucleotide sequences, or, it can be shared by at almost all of the parental polynucleotide sequences. In one aspect, a demarcation point is an area of homology that is shared by all of the parental polynucleotide sequences.

In one aspect, a ligation reassembly process is performed exhaustively in order to generate an exhaustive library of progeny chimeric polynucleotides. In other words, all possible ordered combinations of the nucleic acid building blocks are represented in the set of finalized chimeric nucleic acid molecules. At the same time, in another aspect, the assembly order (i.e. the order of assembly of each building block in the 5' to 3 sequence of each finalized chimeric nucleic acid) in each combination is by design (or non-stochastic) as described above. Because of the non-stochastic nature of this invention, the possibility of unwanted side products is greatly reduced.

In another aspect, the ligation reassembly method is performed systematically. For example, the method is performed in order to generate a systematically compartmentalized library of progeny molecules, with compartments that can be screened systematically, e.g. one by one. In other words this invention provides that, through the selective and judicious use of specific nucleic acid building blocks, coupled with the selective and judicious use of sequentially stepped assembly reactions, a design can be achieved where specific sets of progeny products are made in each of several reaction vessels. This allows a systematic examination and screening procedure to be performed. Thus, these methods allow a potentially very large number of progeny molecules to be examined systematically in smaller groups. Because of its ability to perform chimerizations in a manner that is highly flexible yet exhaustive and systematic as well, particularly when there is a low level of homology among the progenitor molecules, these methods provide for the generation of a library (or set) comprised of a large number of progeny molecules. Because of the non-stochastic nature of the instant ligation reassembly invention, the progeny molecules generated preferably comprise a library of finalized chimeric nucleic acid molecules having an overall assembly order that is chosen by design. The saturation mutagenesis and optimized directed evolution methods also can be used to generate different progeny molecular species. It is appreciated that the invention provides freedom of choice and control regarding the selection of demarcation points, the size and number of the nucleic acid building blocks, and the size and design of the couplings. It is appreciated, furthermore, that the requirement for intermolecular homology is highly relaxed for the operability of this invention. In fact, demarcation points can even be chosen in areas of little or no intermolecular homology. For example, because of codon wobble, i.e. the degeneracy of codons, nucleotide substitutions can be introduced into nucleic acid building blocks without altering the amino acid originally encoded in the corresponding progenitor template. Alternatively, a codon can be altered such that the coding for an originally amino acid is altered. This invention provides that such substitutions can be introduced into the nucleic acid building block in order to increase the incidence of intermolecular homologous demarcation points and thus to allow an increased number of couplings to be achieved among the building blocks, which in turn allows a greater number of progeny chimeric molecules to be generated.

In another aspect, the synthetic nature of the step in which the building blocks are generated allows the design and introduction of nucleotides (e.g., one or more nucleotides, which may be, for example, codons or introns or regulatory sequences) that can later be optionally removed in an in vitro process (e.g. by mutagenesis) or in an in vivo process (e.g. by utilizing the gene splicing ability of a host organism). It is appreciated that in many instances the introduction of these nucleotides may also be desirable for many other reasons in addition to the potential benefit of creating a serviceable demarcation point.

In one aspect, a nucleic acid building block is used to introduce an intron. Thus, functional introns are introduced into a man-made gene manufactured according to the methods described herein. The artificially introduced intron(s) can be functional in a host cells for gene splicing much in the way that naturally-occurring introns serve functionally in gene splicing.

Optimized Directed Evolution System

The invention provides a non-stochastic gene modification system termed "optimized directed evolution system" to generate polypeptides, e.g., proteases or antibodies of the invention, with new or altered properties. Optimized directed evolution is directed to the use of repeated cycles of reductive reassortment, recombination and selection that allow for the directed molecular evolution of nucleic acids through recombination. Optimized directed evolution allows generation of a large population of evolved chimeric sequences, wherein the generated population is significantly enriched for sequences that have a predetermined number of crossover events.

A crossover event is a point in a chimeric sequence where a shift in sequence occurs from one parental variant to another parental variant. Such a point is normally at the juncture of where oligonucleotides from two parents are ligated together to form a single sequence. This method allows calculation of the correct concentrations of oligonucleotide sequences so that the final chimeric population of sequences is enriched for the chosen number of crossover events. This provides more control over choosing chimeric variants having a predetermined number of crossover events.

In addition, this method provides a convenient means for exploring a tremendous amount of the possible protein variant space in comparison to other systems. Previously, if one generated, for example, $10^{13}$ chimeric molecules during a reaction, it would be extremely difficult to test such a high number of chimeric variants for a particular activity. Moreover, a significant portion of the progeny population would have a very high number of crossover events which resulted in proteins that were less likely to have increased levels of a particular activity. By using these methods, the population of chimerics molecules can be enriched for those variants that have a particular number of crossover events. Thus, although one can still generate $10^{13}$ chimeric molecules during a reaction, each of the molecules chosen for further analysis most likely has, for example, only three crossover events. Because the resulting progeny population can be skewed to have a predetermined number of crossover events, the boundaries on the functional variety between the chimeric molecules is reduced. This provides a more manageable number of variables when calculating which oligonucleotide from the original parental polynucleotides might be responsible for affecting a particular trait.

One method for creating a chimeric progeny polynucleotide sequence is to create oligonucleotides corresponding to fragments or portions of each parental sequence. Each oligonucleotide preferably includes a unique region of overlap so that mixing the oligonucleotides together results in a new variant that has each oligonucleotide fragment assembled in the correct order. Additional information can also be found, e.g., in U.S. Ser. No. 09/332,835; U.S. Pat. No. 6,361,974.

The number of oligonucleotides generated for each parental variant bears a relationship to the total number of resulting crossovers in the chimeric molecule that is ultimately created. For example, three parental nucleotide sequence variants might be provided to undergo a ligation reaction in order to find a chimeric variant having, for example, greater activity at high temperature. As one example, a set of 50 oligonucleotide sequences can be generated corresponding to each portions of each parental variant. Accordingly, during the ligation reassembly process there could be up to 50 crossover events within each of the chimeric sequences. The probability that each of the generated chimeric polynucleotides will contain oligonucleotides from each parental variant in alternating order is very low. If each oligonucleotide fragment is present in the ligation reaction in the same molar quantity it is likely that in some positions oligonucleotides from the same parental polynucleotide will ligate next to one another and thus not result in a crossover event. If the concentration of each oligonucleotide from each parent is kept constant during any ligation step in this example, there is a 1/3 chance (assuming 3 parents) that an oligonucleotide from the same parental variant will ligate within the chimeric sequence and produce no crossover.

Accordingly, a probability density function (PDF) can be determined to predict the population of crossover events that are likely to occur during each step in a ligation reaction given a set number of parental variants, a number of oligonucleotides corresponding to each variant, and the concentrations of each variant during each step in the ligation reaction. The statistics and mathematics behind determining the PDF is described below. By utilizing these methods, one can calculate such a probability density function, and thus enrich the chimeric progeny population for a predetermined number of crossover events resulting from a particular ligation reaction. Moreover, a target number of crossover events can be predetermined, and the system then programmed to calculate the starting quantities of each parental oligonucleotide during each step in the ligation reaction to result in a probability density function that centers on the predetermined number of crossover events. These methods are directed to the use of repeated cycles of reductive reassortment, recombination and selection that allow for the directed molecular evolution of a nucleic acid encoding a polypeptide through recombination. This system allows generation of a large population of evolved chimeric sequences, wherein the generated population is significantly enriched for sequences that have a predetermined number of crossover events. A crossover event is a point in a chimeric sequence where a shift in sequence occurs from one parental variant to another parental variant. Such a point is normally at the juncture of where oligonucleotides from two parents are ligated together to form a single sequence. The method allows calculation of the correct concentrations of oligonucleotide sequences so that the final chimeric population of sequences is enriched for the chosen number of crossover events. This provides more control over choosing chimeric variants having a predetermined number of crossover events.

In addition, these methods provide a convenient means for exploring a tremendous amount of the possible protein variant space in comparison to other systems. By using the methods described herein, the population of chimerics molecules can be enriched for those variants that have a particular number of crossover events. Thus, although one can still generate $10^{13}$ chimeric molecules during a reaction, each of the molecules chosen for further analysis most likely has, for example, only three crossover events. Because the resulting progeny population can be skewed to have a predetermined number of crossover events, the boundaries on the functional variety between the chimeric molecules is reduced. This provides a more manageable number of variables when calculating which oligonucleotide from the original parental polynucleotides might be responsible for affecting a particular trait.

In one aspect, the method creates a chimeric progeny polynucleotide sequence by creating oligonucleotides corresponding to fragments or portions of each parental sequence. Each oligonucleotide preferably includes a unique region of overlap so that mixing the oligonucleotides together results in a new variant that has each oligonucleotide fragment assembled in the correct order. See also U.S. Ser. No. 09/332, 835.

Determining Crossover Events

Aspects of the invention include a system and software that receive a desired crossover probability density function (PDF), the number of parent genes to be reassembled, and the number of fragments in the reassembly as inputs. The output of this program is a "fragment PDF" that can be used to determine a recipe for producing reassembled genes, and the estimated crossover PDF of those genes. The processing described herein is preferably performed in MATLAB™ (The Mathworks, Natick, Mass.) a programming language and development environment for technical computing.

Iterative Processes

In practicing the invention, these processes can be iteratively repeated. For example, a nucleic acid (or, the nucleic acid) responsible for an altered or new protease phenotype is identified, re-isolated, again modified, re-tested for activity. This process can be iteratively repeated until a desired phenotype is engineered. For example, an entire biochemical anabolic or catabolic pathway can be engineered into a cell, including, e.g., epoxide hydrolysis activity.

Similarly, if it is determined that a particular oligonucleotide has no affect at all on the desired trait (e.g., a new protease phenotype), it can be removed as a variable by synthesizing larger parental oligonucleotides that include the sequence to be removed. Since incorporating the sequence within a larger sequence prevents any crossover events, there will no longer be any variation of this sequence in the progeny polynucleotides. This iterative practice of determining which oligonucleotides are most related to the desired trait, and which are unrelated, allows more efficient exploration all of the possible protein variants that might be provide a particular trait or activity.

In Vivo Shuffling

In vivo shuffling of molecules is use in methods of the invention that provide variants of polypeptides of the invention, e.g., antibodies, proteases, and the like. In vivo shuffling can be performed utilizing the natural property of cells to recombine multimers. While recombination in vivo has provided the major natural route to molecular diversity, genetic recombination remains a relatively complex process that involves 1) the recognition of homologies; 2) strand cleavage, strand invasion, and metabolic steps leading to the production of recombinant chiasma; and finally 3) the resolution of chiasma into discrete recombined molecules. The formation of the chiasma requires the recognition of homologous sequences.

In one aspect, the invention provides a method for producing a hybrid polynucleotide from at least a first polynucleotide (e.g., a protease of the invention) and a second polynucleotide (e.g., an enzyme, such as a protease of the invention or any other protease, or, a tag or an epitope). The invention can be used to produce a hybrid polynucleotide by introducing at least a first polynucleotide and a second polynucleotide which share at least one region of partial sequence homology into a suitable host cell. The regions of partial sequence homology promote processes which result in sequence reorganization producing a hybrid polynucleotide. The term "hybrid polynucleotide", as used herein, is any nucleotide sequence which results from the method of the present invention and contains sequence from at least two original polynucleotide sequences. Such hybrid polynucleotides can result from intermolecular recombination events which promote sequence integration between DNA molecules. In addition, such hybrid polynucleotides can result from intramolecular reductive reassortment processes which utilize repeated sequences to alter a nucleotide sequence within a DNA molecule.

Producing Sequence Variants

The invention also provides additional methods for making sequence variants of the nucleic acid (e.g., protease) sequences of the invention. The invention also provides additional methods for isolating proteases using the nucleic acids and polypeptides of the invention. In one aspect, the invention provides for variants of a protease coding sequence (e.g., a gene, cDNA or message) of the invention, which can be altered by any means, including, e.g., random or stochastic methods, or, non-stochastic, or "directed evolution," methods, as described above.

The isolated variants may be naturally occurring. Variant can also be created in vitro. Variants may be created using genetic engineering techniques such as site directed mutagenesis, random chemical mutagenesis, Exonuclease III deletion procedures, and standard cloning techniques. Alternatively, such variants, fragments, analogs, or derivatives may be created using chemical synthesis or modification procedures. Other methods of making variants are also familiar to those skilled in the art. These include procedures in which nucleic acid sequences obtained from natural isolates are modified to generate nucleic acids which encode polypeptides having characteristics which enhance their value in industrial or laboratory applications. In such procedures, a large number of variant sequences having one or more nucleotide differences with respect to the sequence obtained from the natural isolate are generated and characterized. These nucleotide differences can result in amino acid changes with respect to the polypeptides encoded by the nucleic acids from the natural isolates.

For example, variants may be created using error prone PCR. In error prone PCR, PCR is performed under conditions where the copying fidelity of the DNA polymerase is low, such that a high rate of point mutations is obtained along the entire length of the PCR product. Error prone PCR is described, e.g., in Leung, D. W., et al., Technique, 1:11-15, 1989) and Caldwell, R. C. & Joyce G. F., PCR Methods Applic., 2:28-33, 1992. Briefly, in such procedures, nucleic acids to be mutagenized are mixed with PCR primers, reaction buffer, $MgCl_2$, $MnCl_2$, Taq polymerase and an appropriate concentration of dNTPs for achieving a high rate of point mutation along the entire length of the PCR product. For example, the reaction may be performed using 20 fmoles of nucleic acid to be mutagenized, 30 pmole of each PCR primer, a reaction buffer comprising 50 mM KCl, 10 mM Tris HCl (pH 8.3) and 0.01% gelatin, 7 mM MgCl2, 0.5 mM $MnCl_2$, 5 units of Taq polymerase, 0.2 mM dGTP, 0.2 mM DATP, 1 mM dCTP, and 1 mM dTTP. PCR may be performed for 30 cycles of 94° C. for 1 min, 45° C. for 1 min, and 72° C. for 1 min. However, it will be appreciated that these parameters may be varied as appropriate. The mutagenized nucleic acids are cloned into an appropriate vector and the activities of the polypeptides encoded by the mutagenized nucleic acids are evaluated.

Variants may also be created using oligonucleotide directed mutagenesis to generate site-specific mutations in any cloned DNA of interest. Oligonucleotide mutagenesis is described, e.g., in Reidhaar-Olson (1988) Science 241:53-57. Briefly, in such procedures a plurality of double stranded oligonucleotides bearing one or more mutations to be introduced into the cloned DNA are synthesized and inserted into the cloned DNA to be mutagenized. Clones containing the mutagenized DNA are recovered and the activities of the polypeptides they encode are assessed.

Another method for generating variants is assembly PCR. Assembly PCR involves the assembly of a PCR product from a mixture of small DNA fragments. A large number of different PCR reactions occur in parallel in the same vial, with the products of one reaction priming the products of another reaction. Assembly PCR is described in, e.g., U.S. Pat. No. 5,965,408.

Still another method of generating variants is sexual PCR mutagenesis. In sexual PCR mutagenesis, forced homologous recombination occurs between DNA molecules of different but highly related DNA sequence in vitro, as a result of random fragmentation of the DNA molecule based on sequence homology, followed by fixation of the crossover by primer extension in a PCR reaction. Sexual PCR mutagenesis is described, e.g., in Stemmer (1994) Proc. Natl. Acad. Sci. USA 91:10747-10751. Briefly, in such procedures a plurality of nucleic acids to be recombined are digested with DNase to generate fragments having an average size of 50-200 nucleotides. Fragments of the desired average size are purified and resuspended in a PCR mixture. PCR is conducted under conditions which facilitate recombination between the nucleic acid fragments. For example, PCR may be performed by resuspending the purified fragments at a concentration of 10-30 ng/µl in a solution of 0.2 mM of each dNTP, 2.2 mM $MgCl_2$, 50 mM KCL, 10 mM Tris HCl, pH 9.0, and 0.1% Triton X-100. 2.5 units of Taq polymerase per 100:1 of reaction mixture is added and PCR is performed using the following regime: 94° C. for 60 seconds, 94° C. for 30 seconds, 50-55° C. for 30 seconds, 72° C. for 30 seconds (30-45 times) and 72° C. for 5 minutes. However, it will be appreciated that these parameters may be varied as appropriate. In some aspects, oligonucleotides may be included in the PCR reactions. In other aspects, the Klenow fragment of DNA polymerase I may be used in a first set of PCR reactions and Taq polymerase may be used in a subsequent set of PCR reactions. Recombinant sequences are isolated and the activities of the polypeptides they encode are assessed.

Variants may also be created by in vivo mutagenesis. In some aspects, random mutations in a sequence of interest are generated by propagating the sequence of interest in a bacterial strain, such as an *E. coli* strain, which carries mutations in one or more of the DNA repair pathways. Such "mutator" strains have a higher random mutation rate than that of a wild-type parent. Propagating the DNA in one of these strains will eventually generate random mutations within the DNA. Mutator strains suitable for use for in vivo mutagenesis are described, e.g., in PCT Publication No. WO 91/16427.

Variants may also be generated using cassette mutagenesis. In cassette mutagenesis a small region of a double stranded DNA molecule is replaced with a synthetic oligonucleotide "cassette" that differs from the native sequence. The oligonucleotide often contains completely and/or partially randomized native sequence.

Recursive ensemble mutagenesis may also be used to generate variants. Recursive ensemble mutagenesis is an algorithm for protein engineering (protein mutagenesis) developed to produce diverse populations of phenotypically related mutants whose members differ in amino acid sequence. This method uses a feedback mechanism to control successive rounds of combinatorial cassette mutagenesis. Recursive ensemble mutagenesis is described, e.g., in Arkin (1992) Proc. Natl. Acad. Sci. USA 89:7811-7815.

In some aspects, variants are created using exponential ensemble mutagenesis. Exponential ensemble mutagenesis is a process for generating combinatorial libraries with a high percentage of unique and functional mutants, wherein small groups of residues are randomized in parallel to identify, at each altered position, amino acids which lead to functional proteins. Exponential ensemble mutagenesis is described, e.g., in Delegrave (1993) Biotechnology Res. 11:1548-1552. Random and site-directed mutagenesis are described, e.g., in Arnold (1993) Current Opinion in Biotechnology 4:450-455.

In some aspects, the variants are created using shuffling procedures wherein portions of a plurality of nucleic acids which encode distinct polypeptides are fused together to create chimeric nucleic acid sequences which encode chimeric polypeptides as described in, e.g., U.S. Pat. Nos. 5,965,408; 5,939,250 (see also discussion, above).

The invention also provides variants of polypeptides of the invention (e.g., proteases) comprising sequences in which one or more of the amino acid residues (e.g., of an exemplary polypeptide of the invention) are substituted with a conserved or non-conserved amino acid residue (e.g., a conserved amino acid residue) and such substituted amino acid residue may or may not be one encoded by the genetic code. Conservative substitutions are those that substitute a given amino acid in a polypeptide by another amino acid of like characteristics. Thus, polypeptides of the invention include those with conservative substitutions of sequences of the invention, e.g., the exemplary polypeptides of the invention, including but not limited to the following replacements: replacements of an aliphatic amino acid such as Alanine, Valine, Leucine and Isoleucine with another aliphatic amino acid; replacement of a Serine with a Threonine or vice versa; replacement of an acidic residue such as Aspartic acid and Glutamic acid with another acidic residue; replacement of a residue bearing an amide group, such as Asparagine and Glutamine, with another residue bearing an amide group; exchange of a basic residue such as Lysine and Arginine with another basic residue; and replacement of an aromatic residue such as Phenylalanine, Tyrosine with another aromatic residue. Other variants are those in which one or more of the amino acid residues of the polypeptides of the invention includes a substituent group.

Other variants within the scope of the invention are those in which the polypeptide is associated with another compound, such as a compound to increase the half-life of the polypeptide, for example, polyethylene glycol.

Additional variants within the scope of the invention are those in which additional amino acids are fused to the polypeptide, such as a leader sequence, a secretory sequence, a proprotein sequence or a sequence which facilitates purification, enrichment, or stabilization of the polypeptide.

In some aspects, the variants, fragments, derivatives and analogs of the polypeptides of the invention retain the same biological function or activity as the exemplary polypeptides, e.g., protease activity, as described herein. In other aspects, the variant, fragment, derivative, or analog includes a proprotein, such that the variant, fragment, derivative, or analog can be activated by cleavage of the proprotein portion to produce an active polypeptide.

Optimizing Codons to Achieve High Levels of Protein Expression in Host Cells

The invention provides methods for modifying protease-encoding nucleic acids to modify codon usage. In one aspect, the invention provides methods for modifying codons in a nucleic acid encoding a protease to increase or decrease its expression in a host cell. The invention also provides nucleic acids encoding a protease modified to increase its expression in a host cell, protease so modified, and methods of making the modified proteases. The method comprises identifying a "non-preferred" or a "less preferred" codon in protease-encoding nucleic acid and replacing one or more of these non-preferred or less preferred codons with a "preferred codon" encoding the same amino acid as the replaced codon and at least one non-preferred or less preferred codon in the nucleic acid has been replaced by a preferred codon encoding the same amino acid. A preferred codon is a codon over-represented in coding sequences in genes in the host cell and a non-preferred or less preferred codon is a codon under-represented in coding sequences in genes in the host cell.

Host cells for expressing the nucleic acids, expression cassettes and vectors of the invention include bacteria, yeast, fungi, plant cells, insect cells and mammalian cells. Thus, the invention provides methods for optimizing codon usage in all of these cells, codon-altered nucleic acids and polypeptides made by the codon-altered nucleic acids. Exemplary host cells include gram negative bacteria, such as *Escherichia coli* and *Pseudomonas fluorescens*; gram positive bacteria, such as *Streptomyces diversa, Lactobacillus gasseri, Lactococcus lactis, Lactococcus cremoris, Bacillus subtilis*. Exemplary host cells also include eukaryotic organisms, e.g., various yeast, such as *Saccharomyces* sp., including *Saccharomyces cerevisiae, Schizosaccharomyces pombe, Pichia pastoris,* and *Kluyveromyces lactis, Hansenula polymorpha, Aspergillus niger*, and mammalian cells and cell lines and insect cells and cell lines. Thus, the invention also includes nucleic acids and polypeptides optimized for expression in these organisms and species.

For example, the codons of a nucleic acid encoding a protease isolated from a bacterial cell are modified such that the nucleic acid is optimally expressed in a bacterial cell different from the bacteria from which the protease was derived, a yeast, a fungi, a plant cell, an insect cell or a mammalian cell. Methods for optimizing codons are well known in the art, see, e.g., U.S. Pat. No. 5,795,737; Baca (2000) Int. J. Parasitol. 30:113-118; Hale (1998) Protein Expr. Purif. 12:185-188; Narum (2001) Infect. Immun. 69:7250-7253. See also Narum (2001) Infect. Immun. 69:7250-7253, describing optimizing codons in mouse systems; Outchkourov (2002) Protein Expr. Purif. 24:18-24, describing optimizing codons in yeast; Feng (2000) Biochemistry 39:15399-15409, describing optimizing codons in *E. coli*; Humphreys (2000) Protein Expr. Purif. 20:252-264, describing optimizing codon usage that affects secretion in *E. coli*.

Transgenic Non-Human Animals

The invention provides transgenic non-human animals comprising a nucleic acid, a polypeptide (e.g., a protease), an expression cassette or vector or a transfected or transformed cell of the invention. The invention also provides methods of making and using these transgenic non-human animals.

The transgenic non-human animals can be, e.g., goats, rabbits, sheep, pigs, cows, rats and mice, comprising the nucleic acids of the invention. These animals can be used, e.g., as in vivo models to study protease activity, or, as models to screen for agents that change the protease activity in vivo. The coding sequences for the polypeptides to be expressed in the transgenic non-human animals can be designed to be constitutive, or, under the control of tissue-specific, developmental-specific or inducible transcriptional regulatory factors. Transgenic non-human animals can be designed and generated using any method known in the art; see, e.g., U.S. Pat. Nos. 6,211,428; 6,187,992; 6,156,952; 6,118,044; 6,111,166; 6,107,541; 5,959,171; 5,922,854; 5,892,070; 5,880,327; 5,891,698; 5,639,940; 5,573,933; 5,387,742; 5,087,571, describing making and using transformed cells and eggs and transgenic mice, rats, rabbits, sheep, pigs and cows. See also, e.g., Pollock (1999) J. Immunol. Methods 231:147-157, describing the production of recombinant proteins in the milk of transgenic dairy animals; Baguisi (1999) Nat. Biotechnol. 17:456-461, demonstrating the production of transgenic goats. U.S. Pat. No. 6,211,428, describes making and using transgenic non-human mammals which express in their brains a nucleic acid construct comprising a DNA sequence. U.S. Pat. No. 5,387,742, describes injecting cloned recombinant or synthetic DNA sequences into fertilized mouse eggs, implanting the injected eggs in pseudo-pregnant females, and growing to term transgenic mice whose cells express proteins related to the pathology of Alzheimer's disease. U.S. Pat. No. 6,187,992, describes making and using a transgenic mouse whose genome comprises a disruption of the gene encoding amyloid precursor protein (APP).

"Knockout animals" can also be used to practice the methods of the invention. For example, in one aspect, the transgenic or modified animals of the invention comprise a "knockout animal," e.g., a "knockout mouse," engineered not to express an endogenous gene, which is replaced with a gene expressing a protease of the invention, or, a fusion protein comprising a protease of the invention.

Transgenic Plants and Seeds

The invention provides transgenic plants and seeds comprising a nucleic acid, a polypeptide (e.g., a protease), an expression cassette or vector or a transfected or transformed cell of the invention. The invention also provides plant products, e.g., oils, seeds, leaves, extracts and the like, comprising a nucleic acid and/or a polypeptide (e.g., a protease) of the invention. The transgenic plant can be dicotyledonous (a dicot) or monocotyledonous (a monocot). The invention also provides methods of making and using these transgenic plants and seeds. The transgenic plant or plant cell expressing a polypeptide of the present invention may be constructed in accordance with any method known in the art. See, for example, U.S. Pat. No. 6,309,872.

Nucleic acids and expression constructs of the invention can be introduced into a plant cell by any means. For example, nucleic acids or expression constructs can be introduced into the genome of a desired plant host, or, the nucleic acids or expression constructs can be episomes. Introduction into the genome of a desired plant can be such that the host's protease production is regulated by endogenous transcriptional or translational control elements. The invention also provides "knockout plants" where insertion of gene sequence by, e.g., homologous recombination, has disrupted the expression of the endogenous gene. Means to generate "knockout" plants are well-known in the art, see, e.g., Strepp (1998) Proc Natl. Acad. Sci. USA 95:4368-4373; Miao (1995) Plant J 7:359-365. See discussion on transgenic plants, below.

The nucleic acids of the invention can be used to confer desired traits on essentially any plant, e.g., on starch-producing plants, such as potato, wheat, rice, barley, and the like. Nucleic acids of the invention can be used to manipulate metabolic pathways of a plant in order to optimize or alter host's expression of protease. The can change protease activity in a plant. Alternatively, a protease of the invention can be used in production of a transgenic plant to produce a compound not naturally produced by that plant. This can lower production costs or create a novel product.

In one aspect, the first step in production of a transgenic plant involves making an expression construct for expression in a plant cell. These techniques are well known in the art. They can include selecting and cloning a promoter, a coding sequence for facilitating efficient binding of ribosomes to mRNA and selecting the appropriate gene terminator sequences. One exemplary constitutive promoter is CaMV35S, from the cauliflower mosaic virus, which generally results in a high degree of expression in plants. Other promoters are more specific and respond to cues in the plant's internal or external environment. An exemplary light-inducible promoter is the promoter from the cab gene, encoding the major chlorophyll a/b binding protein.

In one aspect, the nucleic acid is modified to achieve greater expression in a plant cell. For example, a sequence of the invention is likely to have a higher percentage of A-T nucleotide pairs compared to that seen in a plant, some of which prefer G-C nucleotide pairs. Therefore, A-T nucleotides in the coding sequence can be substituted with G-C nucleotides without significantly changing the amino acid sequence to enhance production of the gene product in plant cells.

Selectable marker gene can be added to the gene construct in order to identify plant cells or tissues that have successfully integrated the transgene. This may be necessary because achieving incorporation and expression of genes in plant cells is a rare event, occurring in just a few percent of the targeted tissues or cells. Selectable marker genes encode proteins that provide resistance to agents that are normally toxic to plants, such as antibiotics or herbicides. Only plant cells that have integrated the selectable marker gene will survive when grown on a medium containing the appropriate antibiotic or herbicide. As for other inserted genes, marker genes also require promoter and termination sequences for proper function.

In one aspect, making transgenic plants or seeds comprises incorporating sequences of the invention and, optionally, marker genes into a target expression construct (e.g., a plasmid), along with positioning of the promoter and the terminator sequences. This can involve transferring the modified gene into the plant through a suitable method. For example, a construct may be introduced directly into the genomic DNA of the plant cell using techniques such as electroporation and microinjection of plant cell protoplasts, or the constructs can be introduced directly to plant tissue using ballistic methods, such as DNA particle bombardment. For example, see, e.g., Christou (1997) Plant Mol. Biol. 35:197-203; Pawlowski (1996) Mol. Biotechnol. 6:17-30; Klein (1987) Nature 327: 70-73; Takumi (1997) Genes Genet. Syst. 72:63-69, discussing use of particle bombardment to introduce transgenes into wheat; and Adam (1997) supra, for use of particle bombardment to introduce YACs into plant cells. For example, Rinehart (1997) supra, used particle bombardment to generate transgenic cotton plants. Apparatus for accelerating particles is described U.S. Pat. No. 5,015,580; and, the commercially available BioRad (Biolistics) PDS-2000 particle acceleration instrument; see also, John, U.S. Pat. No. 5,608,148; and Ellis, U.S. Pat. No. 5,681,730, describing particle-mediated transformation of gymnosperms.

In one aspect, protoplasts can be immobilized and injected with a nucleic acids, e.g., an expression construct. Although plant regeneration from protoplasts is not easy with cereals, plant regeneration is possible in legumes using somatic embryogenesis from protoplast derived callus. Organized tissues can be transformed with naked DNA using gene gun technique, where DNA is coated on tungsten microprojectiles, shot 1/100th the size of cells, which carry the DNA deep into cells and organelles. Transformed tissue is then induced to regenerate, usually by somatic embryogenesis. This technique has been successful in several cereal species including maize and rice.

Nucleic acids, e.g., expression constructs, can also be introduced in to plant cells using recombinant viruses. Plant cells can be transformed using viral vectors, such as, e.g., tobacco mosaic virus derived vectors (Rouwendal (1997) Plant Mol. Biol. 33:989-999), see Porta (1996) "Use of viral replicons for the expression of genes in plants," Mol. Biotechnol. 5:209-221.

Alternatively, nucleic acids, e.g., an expression construct, can be combined with suitable T-DNA flanking regions and introduced into a conventional *Agrobacterium tumefaciens* host vector. The virulence functions of the *Agrobacterium tumefaciens* host will direct the insertion of the construct and adjacent marker into the plant cell DNA when the cell is infected by the bacteria. *Agrobacterium tumefaciens*-mediated transformation techniques, including disarming and use of binary vectors, are well described in the scientific literature. See, e.g., Horsch (1984) *Science* 233:496-498; Fraley (1983) *Proc. Natl. Acad. Sci. USA* 80:4803 (1983); *Gene Transfer to Plants*, Potrykus, ed. (Springer-Verlag, Berlin 1995). The DNA in an *A. tumefaciens* cell is contained in the bacterial chromosome as well as in another structure known as a Ti (tumor-inducing) plasmid. The Ti plasmid contains a stretch of DNA termed T-DNA (~20 kb long) that is transferred to the plant cell in the infection process and a series of vir (virulence) genes that direct the infection process. *A. tumefaciens* can only infect a plant through wounds: when a plant root or stem is wounded it gives off certain chemical signals, in response to which, the vir genes of *A. tumefaciens* become activated and direct a series of events necessary for the transfer of the T-DNA from the Ti plasmid to the plant's chromosome. The T-DNA then enters the plant cell through the wound. One speculation is that the T-DNA waits until the plant DNA is being replicated or transcribed, then inserts itself into the exposed plant DNA. In order to use *A. tumefaciens* as a transgene vector, the tumor-inducing section of T-DNA have to be removed, while retaining the T-DNA border regions and the vir genes. The transgene is then inserted between the T-DNA border regions, where it is transferred to the plant cell and becomes integrated into the plant's chromosomes.

The invention provides for the transformation of monocotyledonous plants using the nucleic acids of the invention, including important cereals, see Hiei (1997) Plant Mol. Biol. 35:205-218. See also, e.g., Horsch, Science (1984) 233:496; Fraley (1983) Proc. Natl. Acad. Sci USA 80:4803; Thykjaer (1997) supra; Park (1996) Plant Mol. Biol. 32:1135-1148, discussing T-DNA integration into genomic DNA. See also D'Halluin, U.S. Pat. No. 5,712,135, describing a process for the stable integration of a DNA comprising a gene that is functional in a cell of a cereal, or other monocotyledonous plant.

In one aspect, the third step can involve selection and regeneration of whole plants capable of transmitting the incorporated target gene to the next generation. Such regeneration techniques rely on manipulation of certain phytohormones in a tissue culture growth medium, typically relying on a biocide and/or herbicide marker that has been introduced together with the desired nucleotide sequences. Plant regeneration from cultured protoplasts is described in Evans et al., *Protoplasts Isolation and Culture, Handbook of Plant Cell Culture*, pp. 124-176, MacMillilan Publishing Company, New York, 1983; and Binding, *Regeneration of Plants, Plant Protoplasts*, pp. 21-73, CRC Press, Boca Raton, 1985. Regeneration can also be obtained from plant callus, explants, organs, or parts thereof. Such regeneration techniques are described generally in Klee (1987) Ann. Rev. of Plant Phys. 38:467-486. To obtain whole plants from transgenic tissues such as immature embryos, they can be grown under controlled environmental conditions in a series of media containing nutrients and hormones, a process known as tissue culture. Once whole plants are generated and produce seed, evaluation of the progeny begins.

After the expression cassette is stably incorporated in transgenic plants, it can be introduced into other plants by sexual crossing. Any of a number of standard breeding techniques can be used, depending upon the species to be crossed. Since transgenic expression of the nucleic acids of the invention leads to phenotypic changes, plants comprising the recombinant nucleic acids of the invention can be sexually crossed with a second plant to obtain a final product. Thus, the seed of the invention can be derived from a cross between two transgenic plants of the invention, or a cross between a plant of the invention and another plant. The desired effects (e.g., expression of the polypeptides of the invention to produce a plant in which flowering behavior is altered) can be enhanced when both parental plants express the polypeptides (e.g., a protease) of the invention. The desired effects can be passed to future plant generations by standard propagation means.

The nucleic acids and polypeptides of the invention are expressed in or inserted in any plant or seed. Transgenic plants of the invention can be dicotyledonous or monocotyledonous. Examples of monocot transgenic plants of the invention are grasses, such as meadow grass (blue grass, *Poa*), forage grass such as festuca, lolium, temperate grass, such as *Agrostis*, and cereals, e.g., wheat, oats, rye, barley, rice, sorghum, and maize (corn). Examples of dicot transgenic plants of the invention are tobacco, legumes, such as lupins, potato, sugar beet, pea, bean and soybean, and cruciferous plants (family Brassicaceae), such as cauliflower, rape seed, and the closely related model organism *Arabidopsis thaliana*. Thus, the transgenic plants and seeds of the invention include a broad range of plants, including, but not limited to, species from the genera *Anacardium, Arachis, Asparagus, Atropa, Avena, Brassica, Citrus, Citrullus, Capsicum, Carthamus, Cocos, Coffea, Cucumis, Cucurbita, Daucus, Elaeis, Fragaria, Glycine, Gossypium, Helianthus, Heterocallis, Hordeum, Hyoscyamus, Lactuca, Linum, Lolium, Lupinus, Lycopersicon, Malus, Manihot, Majorana, Medicago, Nicotiana, Olea, Oryza, Panieum, Pannisetum, Persea, Phaseolus, Pistachia, Pisum, Pyrus, Prunus, Raphanus, Ricinus, Secale, Senecio, Sinapis, Solanum, Sorghum, Theobromus, Trigonella, Triticum, Vicia, Vitis, Vigna,* and *Zea.*

In alternative embodiments, the nucleic acids of the invention are expressed in plants which contain fiber cells, including, e.g., cotton, silk cotton tree (Kapok, *Ceiba pentandra*), desert willow, creosote bush, winterfat, balsa, ramie, kenaf, hemp, roselle, jute, sisal abaca and flax. In alternative embodiments, the transgenic plants of the invention can be members of the genus *Gossypium*, including members of any *Gossypium* species, such as *G. arboreum; G. herbaceum, G. barbadense,* and *G. hirsutum.*

The invention also provides for transgenic plants to be used for producing large amounts of the polypeptides (e.g., a protease or antibody) of the invention. For example, see Palmgren (1997) Trends Genet. 13:348; Chong (1997) Transgenic Res. 6:289-296 (producing human milk protein beta-casein in transgenic potato plants using an auxin-inducible, bidirectional mannopine synthase (mas1',2') promoter with *Agrobacterium tumefaciens*-mediated leaf disc transformation methods).

Using known procedures, one of skill can screen for plants of the invention by detecting the increase or decrease of transgene mRNA or protein in transgenic plants. Means for detecting and quantitation of mRNAs or proteins are well known in the art.

Polypeptides and Peptides

In one aspect, the invention provides isolated or recombinant polypeptides having a sequence identity (e.g., at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity) to an exemplary polypeptide (amino acid) sequence of the invention, e.g., proteins having a sequence as set forth in SEQ ID NO:2; SEQ ID NO:4; SEQ ID NO:6; SEQ ID NO:8; SEQ ID NO:10; SEQ ID NO:12; SEQ ID NO:14; SEQ ID NO:16; SEQ ID NO:18; SEQ ID NO:20; SEQ ID NO:22; SEQ ID NO:24; SEQ ID NO:26; SEQ ID NO:28; SEQ ID NO:30; SEQ ID NO:32; SEQ ID NO:34; SEQ ID NO:36; SEQ ID NO:38; SEQ ID NO:40; SEQ ID NO:42; SEQ ID NO:44; SEQ ID NO:46; SEQ ID NO:48; SEQ ID NO:50; SEQ ID NO:52; SEQ ID NO:54; SEQ ID NO:56; SEQ ID NO:58; SEQ ID NO:60; SEQ ID NO:62; SEQ ID NO:64; SEQ ID NO:66; SEQ ID NO:68; SEQ ID NO:70; SEQ ID NO:72; SEQ ID NO:74; SEQ ID NO:76; SEQ ID NO:78; SEQ ID NO:80; SEQ ID NO:82; SEQ ID NO:84; SEQ ID NO:86; SEQ ID NO:88; SEQ ID NO:90; SEQ ID NO:92; SEQ ID NO:94; SEQ ID NO:96; SEQ ID NO:98; SEQ ID NO:100; SEQ ID NO:102; SEQ ID NO:104; SEQ ID NO:106; SEQ ID NO:108; SEQ ID NO:110; SEQ ID NO:112; SEQ ID NO:114; SEQ ID NO:116; SEQ ID NO:118; SEQ ID NO:120; SEQ ID NO:122; SEQ ID NO:124; SEQ ID NO:126; SEQ ID NO:128; SEQ ID NO:130; SEQ ID NO:132; SEQ ID NO:134; SEQ ID NO:136; SEQ ID NO:138; SEQ ID NO:140; SEQ ID NO:142; SEQ ID NO:144; SEQ ID NO:147; SEQ ID NO:151; SEQ ID NO:159; SEQ ID NO:165; SEQ ID NO:172; SEQ ID NO:180; SEQ ID NO:188; SEQ ID NO:194; SEQ ID NO:200; SEQ ID NO:205; SEQ ID NO:211; SEQ ID NO:219; SEQ ID NO:223; SEQ ID NO:230; SEQ ID NO:235; SEQ ID NO:242; SEQ ID NO:249 or SEQ ID NO:255, or the polypeptide encoded by SEQ ID NO:145. In one aspect, the polypeptide has a protease activity, including proteinase and/or peptidase activity, e.g., the ability to hydrolyze a peptide bond. The protease activity can comprise a peptidase activity, e.g., a carboxypeptidase activity, a dipeptidylpeptidase or an oligopeptidase activity, or an aminopeptidase activity. The protease activity can comprise a serine proteinase activity, a metalloproteinase activity, a cysteine protease activity and/or an aspartic protease activity, or, the same or similar activity to a chymotrypsin, a trypsin, an elastase, a kallikrein and/or a subtilisin.

Exemplary protease activities are set forth in Table 1, Table 2 and Table 3. Assays are described in detail in Examples, below. Assays were developed to determine protease activity on a variety of pNA (para-nitroanalide) linked small peptide substrates as well as protein substrates, such as casein, gelatin, corn zein, soybean trypsin inhibitor, soybean lectin, and wheat germ lectin. For the small peptide substrate assays, hydrolysis of the terminal peptide bond liberates the pNA group and causes an increase in absorbance at 410 nm. To monitor activity on the protein substrates, incubation of the protease and substrate at 37° C. was followed by monitoring the increase in fluorescence from an intramolecularly quenched substrate, by O-phthaldialdehyde (OPA) analysis, where in the presence of BME, OPA reacts with free amino ends to produce a fluorescent imidazole that can be detected using a standard fluorescence plate reader, or by SDS-PAGE analysis, where protease activity is indicated by the reduction or disappearance of substrate band(s).

Proteinase activity on casein, gelatin, or corn zein was also determined using zymograms: zymogram gels contain the enzyme substrate (e.g., alpha-zein) embedded within the gel matrix. If a protease has activity on the zein in the gel, a clearing zone will be produced within an otherwise blue background following electrophoresis, renaturation, development, and staining steps. The clearing zone corresponds to the position of the protease in the gel.

Table 1, below, describes exemplary polypeptides having proteinase activity.

| | SEQ ID NOS: | Casein | Gelatin | AAA | AAPF | BAPNA | GGF | IEGR | PFR |
|---|---|---|---|---|---|---|---|---|---|
| 1 | 1, 2 | + | + | + | + | + | + | − | − |
| 2 | 7, 8 | + | + | + | + | + | + | + | − |
| 3 | 3, 4 | + | − | − | − | − | + | − | − |
| 4 | 5, 6 | + | + | + | + | − | − | + | − |
| 5 | 29, 30 | + | + | + | + | − | + | + | + |
| 6 | 49, 50 | + | + | + | + | − | + | + | + |
| 7 | 23, 24 | + | + | + | + | − | − | + | + |
| 8 | 65, 66 | + | + | − | + | − | − | + | + |

-continued

| SEQ ID NOS: | | Casein | Gelatin | AAA | AAPF | BAPNA | GGF | IEGR | PFR |
|---|---|---|---|---|---|---|---|---|---|
| 9 | 43, 44 | + | + | + | + | − | − | + | + |
| 10 | 67, 68 | + | + | − | + | − | − | − | − |
| 11 | 55, 56 | + | + | + | + | − | + | + | + |
| 12 | 69, 70 | + | + | + | + | − | + | + | + |
| 13 | 61, 62 | + | + | − | + | − | − | + | + |
| 14 | 145, 146 | + | + | + | − | − | − | + | − |
| 15 | 75, 76 | + | + | + | + | − | − | + | + |
| 16 | 31, 32 | + | + | | | | | | |
| 17 | 143, 144 | − | + | | | | | | |
| 18 | 27, 28 | + | + | + | + | − | − | + | + |
| 19 | 79, 80 | + | | + | + | + | − | + | + |
| | Subtilisin A | + | + | + | + | − | + | + | − |

+ Indicates activity was detected on this substrate,
− indicates that activity was not detected on this substrate using the conditions tested, and a blank box indicates that activity on the corresponding substrate has yet to be determined.
(AAPF = N-Suc-Alanine-Proline-Phenylalanine-pNA, AAA = N-Suc-Alanine-Alanine-Alanine-pNA, BAPNA = N-BZ = D,L-Arginine-pNA, GGF = N-Suc-Glycine-Glycine-Phenylalanine-pNA, IEGR = N-Suc-Isoleucine-Glutamate-Glycine-Arginine-pNA, PFR = N-Suc-Proline-Phenylalanine-Arginine-pNA).

Tables 2 and 3, below, describes exemplary polypeptides having peptidase activity, and summarizes their protease activities.

TABLE 2

Exemplary polypeptides having protease activity

| SEQ ID NO | Casein | Gelatin | AAA | AAPF | BAPNA | GGF | IEGR | PFR |
|---|---|---|---|---|---|---|---|---|
| 9, 10 | − | − | − | − | + | − | + | + |
| 15, 16 | − | − | + | − | − | − | − | + |
| 17, 18 | − | − | + | + | − | − | + | + |
| 85, 86 | − | − | − | − | + | + | + | + |
| 63, 64 | − | − | − | + | + | + | + | + |
| 57, 58 | − | − | + | − | − | − | + | − |

TABLE 3

Activity summary

| SEQ ID NOS: | OPA | | | | SDS-PAGE | | | | AquaZe in Zymogram |
|---|---|---|---|---|---|---|---|---|---|
| | Zein | SBTI | SB Lectin | WG Lectin | Zein | SBTI | SB Lectin | WG Lectin | |
| 7, 8 | 1.38 | 1.2 | 1.98 | 1.16 | Yes | | | | Yes |
| 69, 70 | 1.91 | 0.8 | 0.61 | 0.79 | Yes | M | M | Yes | ND |
| 65, 66 | 3.59 | .057* | 0.48 | 0.88 | Yes | ND | ND | ND | ND |
| 73, 74 and 87, 88 | 1.73 | 0.5 | 0.23 | 0.61 | Yes | | | | ND |
| 29, 30 | 2.03 | 1.19 | 0.23 | 0.52 | Yes | M | ND | Yes | Yes |
| 23, 24 | 1.61 | 1.39 | 0.37 | 0.93 | Yes | M | ND | M | Yes |
| 49, 50 | 1.38 | 0.88 | 0.45 | 0.92 | Yes | | | | Yes |
| 93, 94 and 101, 102 | 1.49 | 1.11 | 0.24 | 0.95 | M | Yes | ND | ND | M |
| 103, 104 | 3.05 | 0.98 | 2.64 | 0.86 | Yes | | | | Yes |
| 41, 42 | 1.64 | 0.64 | 0.67 | 0.91 | Yes | | | | Yes |
| 19, 20 | 2.34 | 0.71 | 0.76 | 0.86 | M | | | | Yes |
| 77, 78 | 1.58 | 0.62 | 1.09 | 0.9 | M | | | | M |
| 31, 32 | 2.15 | 0.68 | 0.58 | 0.81 | M | ND | ND | ND | Yes |
| 67, 68 | 1.65 | 1.46 | 0.77 | 0.99 | M | ND | ND | ND | Yes |
| 61, 62 | 1.71 | 0.8 | 0.16 | 0.77 | Yes | ND | ND | ND | ND |
| 21, 22 | 1.44 | 0.96 | 0.47 | 0.93 | M | | | | ND |
| 141, 142 | 1.78 | 1.04 | 0.71 | 1.07 | ND | | | | Yes |
| 1, 2 | | | | | Yes | | | | |
| 43, 44 | 1.59* | 0.86* | 0.43* | 0.8* | ND | ND | ND | ND | Yes |

ND = no detectable activity under the conditions tested, M = Maybe (slight activity under the conditions tested)
*Data from 48 hr time point
Corresponding negative controls were analyzed and shown to have no detectable activity OPA data is expressed as the ratio of the fluorescence (FL) of the enzyme and substrate reaction divided by the sum of the corresponding enzyme only and substrate only controls.

$$\text{Activity Ratio} = \frac{\text{FL substrate and enzyme preparation reaction}}{\text{(FL substrate alone)} + \text{(FL enzyme preparation alone)}}$$

A fluorescence ratio of 1 indicates no activity above background. A fluorescence ratio above 1 indicates the presence of free amino ends created by proteolysis of the substrate by the protease. An FL ratio below 1 may indicate that the protease is inhibited by the substrate such that the hydrolysis of background proteins in the enzyme preparation occurs to a greater extent in the absence of the substrate than it does in the presence of substrate. In this case, the FL background fluorescence in the enzyme only control would be inflated relative to the background component of the enzyme and substrate sample.

The polypeptides of the invention include proteases in an active or inactive form. For example, the polypeptides of the invention include proproteins before "maturation" or processing of prepro sequences, e.g., by a proprotein-processing enzyme, such as a proprotein convertase to generate an "active" mature protein. The polypeptides of the invention include proteases inactive for other reasons, e.g., before "activation" by a post-translational processing event, e.g., an endo- or exo-peptidase or proteinase action, a phosphorylation event, an amidation, a glycosylation or a sulfation, a dimerization event, and the like.

The polypeptides of the invention include all active forms, including active subsequences, e.g., catalytic domains or active sites, of the protease. In one aspect, the invention provides catalytic domains or active sites as set forth below. In one aspect, the invention provides a peptide or polypeptide comprising or consisting of an active site domain as set forth below (the domains were predicted through use of the database, Pfam, which is a large collection of multiple sequence alignments and hidden Markov models covering many common protein families, The Pfam protein families database, A. Bateman, E. Birney, L. Cerruti, R. Durbin, L. Etwiller, S. R. Eddy, S. Griffiths-Jones, K. L. Howe, M. Marshall, and E. L. L. Sonnhammer, Nucleic Acids Research, 30(1):276-280, 2002):

SEQ ID NO: Domains (AA=Amino Acid)
  248, 249 AA(104) . . . (500)
  Eukaryotic aspartyl protease
  AA(112) . . . (317)
  218, 219 Zinc carboxypeptidase
  AA(116) . . . (325)
  179, 180 Zinc carboxypeptidase
  AA(117) . . . (321)
  241, 242 Zinc carboxypeptidase
  AA(121) . . . (228)
  PA (protease associated) domain;
  AA(234) . . . (468)
  193, 194 Peptidase family M28
  AA(124) . . . (340)
  204, 205 Zinc carboxypeptidase
  AA(124) . . . (344)
  199, 200 Zinc carboxypeptidase
  AA(128) . . . (378)
  164, 165 Peptidase family M28
  AA(156) . . . (426)
  Subtilase family;
  AA(74) . . . (142)
  187, 188 Subtilisin N-terminal Region
  AA(234) . . . (471)
  Peptidase family M28;
  AA(115) . . . (224)
  222, 223 PA (protease associated) domain
  AA(239) . . . (439)
  171, 172 Peptidase family M48
  AA(35) . . . (120)
  Subtilisin N-terminal Region; AA(134) . . . (397)
  229, 230 Subtilase family
  AA(5) . . . (389)
  150, 151 Eukaryotic aspartyl protease
  AA(52) . . . (494)
  210, 211 Serine carboxypeptidase
  AA(74) . . . (522)
  254, 255 Serine carboxypeptidase
  AA(96) . . . (532)
  158, 159 Serine carboxypeptidase For example, the invention provides a peptide or polypeptide comprising or consisting of an active site domain as set forth in residues 104 to 500 of SEQ ID NO:249 (as encoded by SEQ ID NO:248), wherein the active site has an aspartyl protease activity. In another aspect, the invention provides a peptide or polypeptide comprising or consisting of an active site domain as set forth in residues 112 to 317 of SEQ ID NO:219 (as encoded by SEQ ID NO:218), wherein the active site has a zinc carboxypeptidase activity, etc.

Methods for identifying "prepro" domain sequences and signal sequences are well known in the art, see, e.g., Van de Ven (1993) Crit. Rev. Oncog. 4(2):115-136. For example, to identify a prepro sequence, the protein is purified from the extracellular space and the N-terminal protein sequence is determined and compared to the unprocessed form.

The invention includes polypeptides with or without a signal sequence and/or a prepro sequence. The invention includes polypeptides with heterologous signal sequences and/or prepro sequences. The prepro sequence (including a sequence of the invention used as a heterologous prepro domain) can be located on the amino terminal or the carboxy terminal end of the protein. The invention also includes isolated or recombinant signal sequences (e.g., see Table 4), prepro sequences and catalytic domains (e.g., "active sites") comprising sequences of the invention.

The percent sequence identity can be over the full length of the polypeptide, or, the identity can be over a region of at least about 50, 60, 70, 80, 90, 100, 150, 200, 250, 300, 350, 400, 450, 500, 550, 600, 650, 700 or more residues. Polypeptides of the invention can also be shorter than the full length of exemplary polypeptides. In alternative aspects, the invention provides polypeptides (peptides, fragments) ranging in size between about 5 and the full length of a polypeptide, e.g., an enzyme, such as a protease; exemplary sizes being of about 5, 10, 15, 20, 25, 30, 35, 40, 45, 50, 55, 60, 65, 70, 75, 80, 85, 90, 100, 125, 150, 175, 200, 250, 300, 350, 400, 450, 500, 550, 600, 650, 700, or more residues, e.g., contiguous residues of an exemplary protease of the invention.

Peptides of the invention (e.g., a subsequence of an exemplary polypeptide of the invention) can be useful as, e.g., labeling probes, antigens, toleragens, motifs, protease active sites (e.g., "catalytic domains"), signal sequences and/or prepro domains.

Polypeptides and peptides of the invention can be isolated from natural sources, be synthetic, or be recombinantly generated polypeptides. Peptides and proteins can be recombinantly expressed in vitro or in vivo. The peptides and polypeptides of the invention can be made and isolated using any method known in the art. Polypeptide and peptides of the invention can also be synthesized, whole or in part, using chemical methods well known in the art. See e.g., Caruthers (1980) Nucleic Acids Res. Symp. Ser. 215-223; Horn (1980) Nucleic Acids Res. Symp. Ser. 225-232; Banga, A. K., Therapeutic Peptides and Proteins, Formulation, Processing and Delivery Systems (1995) Technomic Publishing Co., Lancaster, Pa. For example, peptide synthesis can be performed using various solid-phase techniques (see e.g., Roberge (1995) Science 269:202; Merrifield (1997) Methods Enzymol. 289:3-13) and automated synthesis may be achieved, e.g., using the ABI 431A Peptide Synthesizer (Perkin Elmer) in accordance with the instructions provided by the manufacturer.

The peptides and polypeptides of the invention can also be glycosylated. The glycosylation can be added post-translationally either chemically or by cellular biosynthetic mechanisms, wherein the later incorporates the use of known glycosylation motifs, which can be native to the sequence or can be added as a peptide or added in the nucleic acid coding sequence. The glycosylation can be O-linked or N-linked.

The peptides and polypeptides of the invention, as defined above, include all "mimetic" and "peptidomimetic" forms. The terms "mimetic" and "peptidomimetic" refer to a synthetic chemical compound which has substantially the same structural and/or functional characteristics of the polypeptides of the invention. The mimetic can be either entirely composed of synthetic, non-natural analogues of amino acids, or, is a chimeric molecule of partly natural peptide amino acids and partly non-natural analogs of amino acids. The mimetic can also incorporate any amount of natural amino acid conservative substitutions as long as such substitutions also do not substantially alter the mimetic's structure and/or activity. As with polypeptides of the invention which are conservative variants, routine experimentation will determine whether a mimetic is within the scope of the invention, i.e., that its structure and/or function is not substantially altered. Thus, in one aspect, a mimetic composition is within the scope of the invention if it has a protease activity.

Polypeptide mimetic compositions of the invention can contain any combination of non-natural structural components. In alternative aspect, mimetic compositions of the invention include one or all of the following three structural groups: a) residue linkage groups other than the natural amide bond ("peptide bond") linkages; b) non-natural residues in place of naturally occurring amino acid residues; or c) residues which induce secondary structural mimicry, i.e., to induce or stabilize a secondary structure, e.g., a beta turn, gamma turn, beta sheet, alpha helix conformation, and the like. For example, a polypeptide of the invention can be characterized as a mimetic when all or some of its residues are joined by chemical means other than natural peptide bonds. Individual peptidomimetic residues can be joined by peptide bonds, other chemical bonds or coupling means, such as, e.g., glutaraldehyde, N-hydroxysuccinimide esters, bifunctional maleimides, N,N'-dicyclohexylcarbodiimide (DCC) or N,N'-diisopropylcarbodiimide (DIC). Linking groups that can be an alternative to the traditional amide bond ("peptide bond") linkages include, e.g., ketomethylene (e.g., —C(=O)—CH$_2$— for —C(=O)—NH—), aminomethylene (CH$_2$—NH), ethylene, olefin (CH=CH), ether (CH$_2$—O), thioether (CH$_2$—S), tetrazole (CN$_4$—), thiazole, retroamide, thioamide, or ester (see, e.g., Spatola (1983) in Chemistry and Biochemistry of Amino Acids, Peptides and Proteins, Vol. 7, pp 267-357, "Peptide Backbone Modifications," Marcell Dekker, NY).

A polypeptide of the invention can also be characterized as a mimetic by containing all or some non-natural residues in place of naturally occurring amino acid residues. Non-natural residues are well described in the scientific and patent literature; a few exemplary non-natural compositions useful as mimetics of natural amino acid residues and guidelines are described below. Mimetics of aromatic amino acids can be generated by replacing by, e.g., D- or L-naphylalanine; D- or L-phenylglycine; D- or L-2 thienylalanine; D- or L-1, -2,3-, or 4-pyreneylalanine; D- or L-3 thienylalanine; D- or L-(2-pyridinyl)-alanine; D- or L-(3-pyridinyl)-alanine; D- or L-(2-pyrazinyl)-alanine; D- or L-(4-isopropyl)-phenylglycine; D-(trifluoromethyl)-phenylglycine; D-(trifluoromethyl)-phenylalanine; D-p-fluoro-phenylalanine; D- or L-p-biphenylphenylalanine; D- or L-p-methoxy-biphenylphenylalanine; D- or L-2-indole(alkyl)alanines; and, D- or L-alkylamines, where alkyl can be substituted or unsubstituted methyl, ethyl, propyl, hexyl, butyl, pentyl, isopropyl, iso-butyl, sec-isotyl, iso-pentyl, or a non-acidic amino acids. Aromatic rings of a non-natural amino acid include, e.g., thiazolyl, thiophenyl, pyrazolyl, benzimidazolyl, naphthyl, furanyl, pyrrolyl, and pyridyl aromatic rings.

Mimetics of acidic amino acids can be generated by substitution by, e.g., non-carboxylate amino acids while maintaining a negative charge; (phosphono)alanine; sulfated threonine. Carboxyl side groups (e.g., aspartyl or glutamyl) can also be selectively modified by reaction with carbodiimides (R'—N=C=N—R') such as, e.g., 1-cyclohexyl-3(2-morpholinyl-(4-ethyl) carbodiimide or 1-ethyl-3(4-azonia-4, 4-dimethylpentyl) carbodiimide. Aspartyl or glutamyl can also be converted to asparaginyl and glutaminyl residues by reaction with ammonium ions. Mimetics of basic amino acids can be generated by substitution with, e.g., (in addition to lysine and arginine) the amino acids ornithine, citulline, or (guanidino)-acetic acid, or (guanidino)alkyl-acetic acid, where alkyl is defined above. Nitrile derivative (e.g., containing the CN-moiety in place of COOH) can be substituted for asparagine or glutamine. Asparaginyl and glutaminyl residues can be deaminated to the corresponding aspartyl or glutamyl residues. Arginine residue mimetics can be generated by reacting arginyl with, e.g., one or more conventional reagents, including, e.g., phenylglyoxal, 2,3-butanedione, 1,2-cyclo-hexanedione, or ninhydrin, preferably under alkaline conditions. Tyrosine residue mimetics can be generated by reacting tyrosyl with, e.g., aromatic diazonium compounds or tetranitromethane. N-acetylimidizol and tetranitromethane can be used to form O-acetyl tyrosyl species and 3-nitro derivatives, respectively. Cysteine residue mimetics can be generated by reacting cysteinyl residues with, e.g., alpha-haloacetates such as 2-chloroacetic acid or chloroacetamide and corresponding amines; to give carboxymethyl or carboxyamidomethyl derivatives. Cysteine residue mimetics can also be generated by reacting cysteinyl residues with, e.g., bromo-trifluoroacetone, alpha-bromo-beta-(5-imidazoyl) propionic acid; chloroacetyl phosphate, N-alkylmaleimides, 3-nitro-2-pyridyl disulfide; methyl 2-pyridyl disulfide; p-chloromercuribenzoate; 2-chloromercuri-4 nitrophenol; or, chloro-7-nitrobenzo-oxa-1,3-diazole. Lysine mimetics can be generated (and amino terminal residues can be altered) by reacting lysinyl with, e.g., succinic or other carboxylic acid anhydrides. Lysine and other alpha-amino-containing residue mimetics can also be generated by reaction with imidoesters, such as methyl picolinimidate, pyridoxal phosphate, pyridoxal, chloroborohydride, trinitro-benzene-sulfonic acid, O-methylisourea, 2,4, pentanedione, and transamidase-catalyzed reactions with glyoxylate. Mimetics of methionine can be generated by reaction with, e.g., methionine sulfoxide. Mimetics of proline include, e.g., pipecolic acid, thiazolidine carboxylic acid, 3- or 4-hydroxy proline, dehydroproline, 3- or 4-methylproline, or 3,3-dimethylproline. Histidine residue mimetics can be generated by reacting histidyl with, e.g., diethylprocarbonate or para-bromophenacyl bromide. Other mimetics include, e.g., those generated by hydroxylation of proline and lysine; phosphorylation of the hydroxyl groups of seryl or threonyl residues; methylation of the alpha-amino groups of lysine, arginine and histidine; acetylation of the N-terminal amine; methylation of main chain amide residues or substitution with N-methyl amino acids; or amidation of C-terminal carboxyl groups.

A residue, e.g., an amino acid, of a polypeptide of the invention can also be replaced by an amino acid (or peptidomimetic residue) of the opposite chirality. Thus, any amino acid naturally occurring in the L-configuration (which can also be referred to as the R or S, depending upon the structure of the chemical entity) can be replaced with the amino acid of the same chemical structural type or a peptidomimetic, but of the opposite chirality, referred to as the D-amino acid, but also can be referred to as the R- or S-form.

The invention also provides methods for modifying the polypeptides of the invention by either natural processes, such as post-translational processing (e.g., phosphorylation, acylation, etc), or by chemical modification techniques, and the resulting modified polypeptides. Modifications can occur anywhere in the polypeptide, including the peptide backbone, the amino acid side-chains and the amino or carboxyl termini. It will be appreciated that the same type of modification may be present in the same or varying degrees at several sites in a given polypeptide. Also a given polypeptide may have many types of modifications. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of a phosphatidylinositol, cross-linking cyclization, disulfide bond formation, demethylation, formation of covalent crosslinks, formation of cysteine, formation of pyroglutamate, formylation, gamma-carboxylation, glycosylation, GPI anchor formation, hydroxylation, iodination, methylation, myristolyation, oxidation, pegylation, proteolytic processing, phosphorylation, prenylation, racemization, selenoylation, sulfation, and transfer-RNA mediated addition of amino acids to protein such as arginylation. See, e.g., Creighton, T. E., Proteins—Structure and Molecular Properties 2nd Ed., W.H. Freeman and Company, New York (1993); Posttranslational Covalent Modification of Proteins, B. C. Johnson, Ed., Academic Press, New York, pp. 1-12 (1983).

Solid-phase chemical peptide synthesis methods can also be used to synthesize the polypeptide or fragments of the invention. Such method have been known in the art since the early 1960's (Merrifield, R. B., J. Am. Chem. Soc., 85:2149-2154, 1963) (See also Stewart, J. M. and Young, J. D., Solid Phase Peptide Synthesis, 2nd Ed., Pierce Chemical Co., Rockford, Ill., pp. 11-12)) and have recently been employed in commercially available laboratory peptide design and synthesis kits (Cambridge Research Biochemicals). Such commercially available laboratory kits have generally utilized the teachings of H. M. Geysen et al, Proc. Natl. Acad. Sci., USA, 81:3998 (1984) and provide for synthesizing peptides upon the tips of a multitude of "rods" or "pins" all of which are connected to a single plate. When such a system is utilized, a plate of rods or pins is inverted and inserted into a second plate of corresponding wells or reservoirs, which contain solutions for attaching or anchoring an appropriate amino acid to the pin's or rod's tips. By repeating such a process step, i.e., inverting and inserting the rod's and pin's tips into appropriate solutions, amino acids are built into desired peptides. In addition, a number of available FMOC peptide synthesis systems are available. For example, assembly of a polypeptide or fragment can be carried out on a solid support using an Applied Biosystems, Inc. Model 431A™ automated peptide synthesizer. Such equipment provides ready access to the peptides of the invention, either by direct synthesis or by synthesis of a series of fragments that can be coupled using other known techniques.

The invention includes proteases of the invention with and without signal. The polypeptide comprising a signal sequence of the invention (e.g., see Table 4) can be a protease of the invention or another protease or another enzyme or other polypeptide.

The invention includes immobilized proteases, anti-protease antibodies and fragments thereof. The invention provides methods for inhibiting protease activity, e.g., using dominant negative mutants or anti-protease antibodies of the invention. The invention includes heterocomplexes, e.g., fusion proteins, heterodimers, etc., comprising the proteases of the invention.

Polypeptides of the invention can have a protease activity under various conditions, e.g., extremes in pH and/or temperature, oxidizing agents, and the like. The invention provides methods leading to alternative protease preparations with different catalytic efficiencies and stabilities, e.g., towards temperature, oxidizing agents and changing wash conditions. In one aspect, protease variants can be produced using techniques of site-directed mutagenesis and/or random mutagenesis. In one aspect, directed evolution can be used to produce a great variety of protease variants with alternative specificities and stability.

The proteins of the invention are also useful as research reagents to identify protease modulators, e.g., activators or inhibitors of protease activity. Briefly, test samples (compounds, broths, extracts, and the like) are added to protease assays to determine their ability to inhibit substrate cleavage. Inhibitors identified in this way can be used in industry and research to reduce or prevent undesired proteolysis. As with proteases, inhibitors can be combined to increase the spectrum of activity.

The enzymes of the invention are also useful as research reagents to digest proteins or in protein sequencing. For example, the proteases may be used to break polypeptides into smaller fragments for sequencing using, e.g. an automated sequencer.

The invention also provides methods of discovering new proteases using the nucleic acids, polypeptides and antibodies of the invention. In one aspect, phagemid libraries are screened for expression-based discovery of proteases In another aspect, lambda phage libraries are screened for expression-based discovery of proteases. Screening of the phage or phagemid libraries can allow the detection of toxic clones; improved access to substrate; reduced need for engineering a host, by-passing the potential for any bias resulting from mass excision of the library; and, faster growth at low clone densities. Screening of phage or phagemid libraries can be in liquid phase or in solid phase. In one aspect, the invention provides screening in liquid phase. This gives a greater flexibility in assay conditions; additional substrate flexibility; higher sensitivity for weak clones; and ease of automation over solid phase screening.

The invention provides screening methods using the proteins and nucleic acids of the invention and robotic automation to enable the execution of many thousands of biocatalytic reactions and screening assays in a short period of time, e.g., per day, as well as ensuring a high level of accuracy and reproducibility (see discussion of arrays, below). As a result, a library of derivative compounds can be produced in a matter of weeks. For further teachings on modification of molecules, including small molecules, see PCT/US94/09174.

The present invention includes protease enzymes which are non-naturally occurring carbonyl hydrolase variants (e.g., protease variants) having a different proteolytic activity, stability, substrate specificity, pH profile and/or performance characteristic as compared to the precursor carbonyl hydrolase from which the amino acid sequence of the variant is derived. Specifically, such protease variants have an amino acid sequence not found in nature, which is derived by substitution of a plurality of amino acid residues of a precursor protease with different amino acids. The precursor protease may be a naturally-occurring protease or a recombinant protease. The useful protease variants encompass the substitution of any of the naturally occurring L-amino acids at the designated amino acid residue positions.

Protease Signal Sequences, Prepro and Catalytic Domains

The invention provides protease signal sequences (e.g., signal peptides (SPs)), prepro domains and catalytic domains (CDs). The SPs, prepro domains and/or CDs of the invention can be isolated or recombinant peptides or can be part of a fusion protein, e.g., as a heterologous domain in a chimeric protein. The invention provides nucleic acids encoding these catalytic domains (CDs), prepro domains and signal sequences (SPs, e.g., a peptide having a sequence comprising/consisting of amino terminal residues of a polypeptide of the invention).

In one aspect, the invention provides a signal sequence comprising a peptide comprising/consisting of a sequence as set forth in residues 1 to 12, 1 to 13, 1 to 14, 1 to 15, 1 to 16, 1 to 17, 1 to 18, 1 to 19, 1 to 20, 1 to 21, 1 to 22, 1 to 23, 1 to 24, 1 to 25, 1 to 26, 1 to 27, 1 to 28, 1 to 29, 1 to 30, 1 to 31, 1 to 32, 1 to 33, 1 to 34, 1 to 35, 1 to 36, 1 to 37, 1 to 38, 1 to 39, 1 to 40, 1 to 41, 1 to 42, 1 to 43, 1 to 44 (or a longer peptide) of a polypeptide of the invention.

In an alternative aspect, the invention provides a signal sequence comprising a peptide comprising/consisting of a sequence as set forth in Table 4, below:

| SEQ ID NO: | Signal (AA) |
|---|---|
| 1, 2 | 1-37 |
| 101, 102 | 1-22 |
| 111, 112 | 1-36 |
| 113, 114 | 1-32 |
| 115, 116 | 1-33 |
| 121, 122 | 1-25 |
| 123, 124 | 1-56 |
| 127, 128 | 1-27 |
| 13, 14 | 1-33 |
| 131, 132 | 1-21 |
| 133, 134 | 1-27 |
| 139, 140 | 1-38 |
| 141, 142 | 1-25 |
| 143, 144 | 1-35 |
| 15, 16 | 1-31 |
| 164, 165 | 1-17 |
| 179, 180 | 1-21 |
| 19, 20 | 1-39 |
| 193, 194 | 1-19 |
| 199, 200 | 1-18 |
| 21, 22 | 1-22 |
| 210, 211 | 1-19 |
| 222, 223 | 1-15 |
| 229, 230 | 1-21 |
| 23, 24 | 1-23 |

-continued

| SEQ ID NO: | Signal (AA) |
|---|---|
| 241, 242 | 1-20 |
| 254, 255 | 1-18 |
| 27, 28 | 1-27 |
| 29, 30 | 1-24 |
| 3, 4 | 1-36 |
| 31, 32 | 1-26 |
| 35, 36 | 1-27 |
| 37, 38 | 1-37 |
| 41, 42 | 1-22 |
| 43, 44 | 1-25 |
| 45, 46 | 1-26 |
| 47, 48 | 1-24 |
| 49, 50 | 1-30 |
| 5, 6 | 1-32 |
| 51, 52 | 1-27 |
| 53, 54 | 1-32 |
| 55, 56 | 1-27 |
| 57, 58 | 1-31 |
| 61, 62 | 1-40 |
| 67, 68 | 1-27 |
| 69, 70 | 1-32 |
| 71, 72 | 1-25 |
| 73, 74 | 1-28 |
| 75, 76 | 1-25 |
| 81, 82 | 1-20 |
| 83, 84 | 1-22 |
| 85, 86 | 1-20 |
| 87, 88 | 1-35 |
| 89, 90 | 1-32 |
| 9, 10 | 1-28 |
| 93, 94 | 1-36 |
| 95, 96 | 1-24 |

The protease signal sequences (SPs) and/or prepro sequences of the invention can be isolated peptides, or, sequences joined to another protease or a non-protease polypeptide, e.g., as a fusion (chimeric) protein. In one aspect, the invention provides polypeptides comprising protease signal sequences of the invention. In one aspect, polypeptides comprising protease signal sequences SPs and/or prepro of the invention comprise sequences heterologous to a protease of the invention (e.g., a fusion protein comprising an SP and/or prepro of the invention and sequences from another protease or a non-protease protein). In one aspect, the invention provides proteases of the invention with heterologous SPs and/or prepro sequences, e.g., sequences with a yeast signal sequence. A protease of the invention can comprise a heterologous SP and/or prepro in a vector, e.g., a pPIC series vector (Invitrogen, Carlsbad, Calif.).

In one aspect, SPs and/or prepro sequences of the invention are identified following identification of novel protease polypeptides. The pathways by which proteins are sorted and transported to their proper cellular location are often referred to as protein targeting pathways. One of the most important elements in all of these targeting systems is a short amino acid sequence at the amino terminus of a newly synthesized polypeptide called the signal sequence. This signal sequence directs a protein to its appropriate location in the cell and is removed during transport or when the protein reaches its final destination. Most lysosomal, membrane, or secreted proteins have an amino-terminal signal sequence that marks them for translocation into the lumen of the endoplasmic reticulum. More than 100 signal sequences for proteins in this group have been determined. The signal sequences can vary in length from 13 to 36 amino acid residues. Various methods of recognition of signal sequences are known to those of skill in the art. For example, in one aspect, novel protease signal peptides are identified by a method referred to as SignalP.

SignalP uses a combined neural network which recognizes both signal peptides and their cleavage sites. (Nielsen, et al., "Identification of prokaryotic and eukaryotic signal peptides and prediction of their cleavage sites." Protein Engineering, vol. 10, no. 1, p. 1-6 (1997).

It should be understood that in some aspects proteases of the invention may not have SPs and/or prepro sequences, or "domains." In one aspect, the invention provides the proteases of the invention lacking all or part of an SP and/or a prepro domain. In one aspect, the invention provides a nucleic acid sequence encoding a signal sequence (SP) and/or prepro from one protease operably linked to a nucleic acid sequence of a different protease or, optionally, a signal sequence (SPs) and/or prepro domain from a non-protease protein may be desired.

The invention also provides isolated or recombinant polypeptides comprising signal sequences (SPs), prepro domain and/or catalytic domains (CDs) of the invention and heterologous sequences. The heterologous sequences are sequences not naturally associated (e.g., to a protease) with an SP, prepro domain and/or CD. The sequence to which the SP, prepro domain and/or CD are not naturally associated can be on the SP's, prepro domain and/or CD's amino terminal end, carboxy terminal end, and/or on both ends of the SP and/or CD. In one aspect, the invention provides an isolated or recombinant polypeptide comprising (or consisting of) a polypeptide comprising a signal sequence (SP), prepro domain and/or catalytic domain (CD) of the invention with the proviso that it is not associated with any sequence to which it is naturally associated (e.g., a protease sequence). Similarly in one aspect, the invention provides isolated or recombinant nucleic acids encoding these polypeptides. Thus, in one aspect, the isolated or recombinant nucleic acid of the invention comprises coding sequence for a signal sequence (SP), prepro domain and/or catalytic domain (CD) of the invention and a heterologous sequence (i.e., a sequence not naturally associated with the a signal sequence (SP), prepro domain and/or catalytic domain (CD) of the invention). The heterologous sequence can be on the 3' terminal end, 5' terminal end, and/or on both ends of the SP, prepro domain and/or CD coding sequence.

Hybrid (Chimeric) Proteases and Peptide Libraries

In one aspect, the invention provides hybrid proteases and fusion proteins, including peptide libraries, comprising sequences of the invention. The peptide libraries of the invention can be used to isolate peptide modulators (e.g., activators or inhibitors) of targets, such as protease substrates, receptors, enzymes. The peptide libraries of the invention can be used to identify formal binding partners of targets, such as ligands, e.g., cytokines, hormones and the like. In one aspect, the invention provides chimeric proteins comprising a signal sequence (SP), prepro domain and/or catalytic domain (CD) of the invention or a combination thereof and a heterologous sequence (see above).

In one aspect, the fusion proteins of the invention (e.g., the peptide moiety) are conformationally stabilized (relative to linear peptides) to allow a higher binding affinity for targets. The invention provides fusions of proteases of the invention and other peptides, including known and random peptides. They can be fused in such a manner that the structure of the proteases is not significantly perturbed and the peptide is metabolically or structurally conformationally stabilized. This allows the creation of a peptide library that is easily monitored both for its presence within cells and its quantity.

Amino acid sequence variants of the invention can be characterized by a predetermined nature of the variation, a feature that sets them apart from a naturally occurring form, e.g., an allelic or interspecies variation of a protease sequence. In one aspect, the variants of the invention exhibit the same qualitative biological activity as the naturally occurring analogue. Alternatively, the variants can be selected for having modified characteristics. In one aspect, while the site or region for introducing an amino acid sequence variation is predetermined, the mutation per se need not be predetermined. For example, in order to optimize the performance of a mutation at a given site, random mutagenesis may be conducted at the target codon or region and the expressed protease variants screened for the optimal combination of desired activity. Techniques for making substitution mutations at predetermined sites in DNA having a known sequence are well known, as discussed herein for example, M13 primer mutagenesis and PCR mutagenesis. Screening of the mutants can be done using assays of proteolytic activities. In alternative aspects, amino acid substitutions can be single residues; insertions can be on the order of from about 1 to 20 amino acids, although considerably larger insertions can be done. Deletions can range from about 1 to about 20, 30, 40, 50, 60, 70 residues or more. To obtain a final derivative with the optimal properties, substitutions, deletions, insertions or any combination thereof may be used. Generally, these changes are done on a few amino acids to minimize the alteration of the molecule. However, larger changes may be tolerated in certain circumstances.

The invention provides proteases where the structure of the polypeptide backbone, the secondary or the tertiary structure, e.g., an alpha-helical or beta-sheet structure, has been modified. In one aspect, the charge or hydrophobicity has been modified. In one aspect, the bulk of a side chain has been modified. Substantial changes in function or immunological identity are made by selecting substitutions that are less conservative. For example, substitutions can be made which more significantly affect: the structure of the polypeptide backbone in the area of the alteration, for example a alpha-helical or a beta-sheet structure; a charge or a hydrophobic site of the molecule, which can be at an active site; or a side chain. The invention provides substitutions in polypeptide of the invention where (a) a hydrophilic residues, e.g. seryl or threonyl, is substituted for (or by) a hydrophobic residue, e.g. leucyl, isoleucyl, phenylalanyl, valyl or alanyl; (b) a cysteine or proline is substituted for (or by) any other residue; (c) a residue having an electropositive side chain, e.g. lysyl, arginyl, or histidyl, is substituted for (or by) an electronegative residue, e.g. glutamyl or aspartyl; or (d) a residue having a bulky side chain, e.g. phenylalanine, is substituted for (or by) one not having a side chain, e.g. glycine. The variants can exhibit the same qualitative biological activity (i.e. protease activity) although variants can be selected to modify the characteristics of the proteases as needed.

In one aspect, proteases of the invention comprise epitopes or purification tags, signal sequences or other fusion sequences, etc. In one aspect, the proteases of the invention can be fused to a random peptide to form a fusion polypeptide. By "fused" or "operably linked" herein is meant that the random peptide and the protease are linked together, in such a manner as to minimize the disruption to the stability of the protease structure, e.g., it retains protease activity. The fusion polypeptide (or fusion polynucleotide encoding the fusion polypeptide) can comprise further components as well, including multiple peptides at multiple loops.

In one aspect, the peptides and nucleic acids encoding them are randomized, either fully randomized or they are biased in their randomization, e.g. in nucleotide/residue frequency generally or per position. "Randomized" means that each nucleic acid and peptide consists of essentially random nucleotides and amino acids, respectively. In one aspect, the nucleic acids which give rise to the peptides can be chemically synthesized, and thus may incorporate any nucleotide at any position. Thus, when the nucleic acids are expressed to form peptides, any amino acid residue may be incorporated at any position. The synthetic process can be designed to generate randomized nucleic acids, to allow the formation of all or most of the possible combinations over the length of the nucleic acid, thus forming a library of randomized nucleic acids. The library can provide a sufficiently structurally diverse population of randomized expression products to affect a probabilistically sufficient range of cellular responses to provide one or more cells exhibiting a desired response. Thus, the invention provides an interaction library large enough so that at least one of its members will have a structure that gives it affinity for some molecule, protein, or other factor.

Screening Methodologies and "On-Line" Monitoring Devices

In practicing the methods of the invention, a variety of apparatus and methodologies can be used to in conjunction with the polypeptides and nucleic acids of the invention, e.g., to screen polypeptides for protease activity (e.g., assays such as hydrolysis of casein in zymograms, the release of fluorescence from gelatin, or the release of p-nitroanilide from various small peptide substrates), to screen compounds as potential modulators, e.g., activators or inhibitors, of a protease activity, for antibodies that bind to a polypeptide of the invention, for nucleic acids that hybridize to a nucleic acid of the invention, to screen for cells expressing a polypeptide of the invention and the like. In addition to the array formats described in detail below for screening samples, alternative formats can also be used to practice the methods of the invention. Such formats include, for example, mass spectrometers, chromatographs, e.g., high-throughput HPLC and other forms of liquid chromatography, and smaller formats, such as 1536-well plates, 384-well plates and so on. High throughput screening apparatus can be adapted and used to practice the methods of the invention, see, e.g., U.S. Patent Application No. 20020001809.

Capillary Arrays

Nucleic acids or polypeptides of the invention can be immobilized to or applied to an array. Arrays can be used to screen for or monitor libraries of compositions (e.g., small molecules, antibodies, nucleic acids, etc.) for their ability to bind to or modulate the activity of a nucleic acid or a polypeptide of the invention. Capillary arrays, such as the GIGAMATRIX™, Diversa Corporation, San Diego, Calif.; and arrays described in, e.g., U.S. Patent Application No. 20020080350 A1; WO 0231203 A; WO 0244336 A, provide an alternative apparatus for holding and screening samples. In one aspect, the capillary array includes a plurality of capillaries formed into an array of adjacent capillaries, wherein each capillary comprises at least one wall defining a lumen for retaining a sample. The lumen may be cylindrical, square, hexagonal or any other geometric shape so long as the walls form a lumen for retention of a liquid or sample. The capillaries of the capillary array can be held together in close proximity to form a planar structure. The capillaries can be bound together, by being fused (e.g., where the capillaries are made of glass), glued, bonded, or clamped side-by-side. Additionally, the capillary array can include interstitial material disposed between adjacent capillaries in the array, thereby forming a solid planar device containing a plurality of through-holes.

A capillary array can be formed of any number of individual capillaries, for example, a range from 100 to 4,000,000 capillaries. Further, a capillary array having about 100,000 or more individual capillaries can be formed into the standard size and shape of a Microtiter® plate for fitment into standard laboratory equipment. The lumens are filled manually or automatically using either capillary action or microinjection using a thin needle. Samples of interest may subsequently be removed from individual capillaries for further analysis or characterization. For example, a thin, needle-like probe is positioned in fluid communication with a selected capillary to either add or withdraw material from the lumen.

In a single-pot screening assay, the assay components are mixed yielding a solution of interest, prior to insertion into the capillary array. The lumen is filled by capillary action when at least a portion of the array is immersed into a solution of interest. Chemical or biological reactions and/or activity in each capillary are monitored for detectable events. A detectable event is often referred to as a "hit", which can usually be distinguished from "non-hit" producing capillaries by optical detection. Thus, capillary arrays allow for massively parallel detection of "hits".

In a multi-pot screening assay, a polypeptide or nucleic acid, e.g., a ligand, can be introduced into a first component, which is introduced into at least a portion of a capillary of a capillary array. An air bubble can then be introduced into the capillary behind the first component. A second component can then be introduced into the capillary, wherein the second component is separated from the first component by the air bubble. The first and second components can then be mixed by applying hydrostatic pressure to both sides of the capillary array to collapse the bubble. The capillary array is then monitored for a detectable event resulting from reaction or non-reaction of the two components.

In a binding screening assay, a sample of interest can be introduced as a first liquid labeled with a detectable particle into a capillary of a capillary array, wherein the lumen of the capillary is coated with a binding material for binding the detectable particle to the lumen. The first liquid may then be removed from the capillary tube, wherein the bound detectable particle is maintained within the capillary, and a second liquid may be introduced into the capillary tube. The capillary is then monitored for a detectable event resulting from reaction or non-reaction of the particle with the second liquid.

Arrays, or "Biochips"

Nucleic acids or polypeptides of the invention can be immobilized to or applied to an array. Arrays can be used to screen for or monitor libraries of compositions (e.g., small molecules, antibodies, nucleic acids, etc.) for their ability to bind to or modulate the activity of a nucleic acid or a polypeptide of the invention. For example, in one aspect of the invention, a monitored parameter is transcript expression of a protease gene. One or more, or, all the transcripts of a cell can be measured by hybridization of a sample comprising transcripts of the cell, or, nucleic acids representative of or complementary to transcripts of a cell, by hybridization to immobilized nucleic acids on an array, or "biochip." By using an "array" of nucleic acids on a microchip, some or all of the transcripts of a cell can be simultaneously quantified. Alternatively, arrays comprising genomic nucleic acid can also be used to determine the genotype of a newly engineered strain made by the methods of the invention. Polypeptide arrays" can also be used to simultaneously quantify a plurality of proteins. The present invention can be practiced with any known "array," also referred to as a "microarray" or "nucleic acid array" or "polypeptide array" or "antibody array" or "biochip," or variation thereof. Arrays are generically a plurality of "spots" or "target elements," each target element comprising a defined amount of one or more biological molecules, e.g., oligonucleotides, immobilized onto a defined area of a substrate surface for specific binding to a sample molecule, e.g., mRNA transcripts.

In practicing the methods of the invention, any known array and/or method of making and using arrays can be incorporated in whole or in part, or variations thereof, as described, for example, in U.S. Pat. Nos. 6,277,628; 6,277,489; 6,261,776; 6,258,606; 6,054,270; 6,048,695; 6,045,996; 6,022,963; 6,013,440; 5,965,452; 5,959,098; 5,856,174; 5,830,645; 5,770,456; 5,632,957; 5,556,752; 5,143,854; 5,807,522; 5,800,992; 5,744,305; 5,700,637; 5,556,752; 5,434,049; see also, e.g., WO 99/51773; WO 99/09217; WO 97/46313; WO 96/17958; see also, e.g., Johnston (1998) Curr. Biol. 8:R171-R174; Schummer (1997) Biotechniques 23:1087-1092; Kern (1997) Biotechniques 23:120-124; Solinas-Toldo (1997) Genes, Chromosomes & Cancer 20:399-407; Bowtell (1999) Nature Genetics Supp. 21:25-32. See also published U.S. patent applications Nos. 20010018642; 20010019827; 20010016322; 20010014449; 20010014448; 20010012537; 20010008765.

Antibodies and Antibody-Based Screening Methods

The invention provides isolated or recombinant antibodies that specifically bind to a protease of the invention. These antibodies can be used to isolate, identify or quantify the proteases of the invention or related polypeptides. These antibodies can be used to isolate other polypeptides within the scope the invention or other related proteases. The antibodies can be designed to bind to an active site of a protease. Thus, the invention provides methods of inhibiting proteases using the antibodies of the invention (see discussion above regarding applications for anti-protease compositions of the invention).

The invention provides fragments of the enzymes of the invention, including immunogenic fragments of a polypeptide of the invention, e.g., SEQ ID NO:2; SEQ ID NO:4; SEQ ID NO:6; SEQ ID NO:8; SEQ ID NO:10; SEQ ID NO:12; SEQ ID NO:14; SEQ ID NO:16; SEQ ID NO:18; SEQ ID NO:20; SEQ ID NO:22; SEQ ID NO:24; SEQ ID NO:26; SEQ ID NO:28; SEQ ID NO:30; SEQ ID NO:32; SEQ ID NO:34; SEQ ID NO:36; SEQ ID NO:38; SEQ ID NO:40; SEQ ID NO:42; SEQ ID NO:44; SEQ ID NO:46; SEQ ID NO:48; SEQ ID NO:50; SEQ ID NO:52; SEQ ID NO:54; SEQ ID NO:56; SEQ ID NO:58; SEQ ID NO:60; SEQ ID NO:62; SEQ ID NO:64; SEQ ID NO:66; SEQ ID NO:68; SEQ ID NO:70; SEQ ID NO:72; SEQ ID NO:74; SEQ ID NO:76; SEQ ID NO:78; SEQ ID NO:80; SEQ ID NO:82; SEQ ID NO:84; SEQ ID NO:86; SEQ ID NO:88; SEQ ID NO:90; SEQ ID NO:92; SEQ ID NO:94; SEQ ID NO:96; SEQ ID NO:98; SEQ ID NO:100; SEQ ID NO:102; SEQ ID NO:104; SEQ ID NO:106; SEQ ID NO:108; SEQ ID NO:110; SEQ ID NO:112; SEQ ID NO:114; SEQ ID NO:116; SEQ ID NO:118; SEQ ID NO:120; SEQ ID NO:122; SEQ ID NO:124; SEQ ID NO:126; SEQ ID NO:128; SEQ ID NO:130; SEQ ID NO:132; SEQ ID NO:134; SEQ ID NO:136; SEQ ID NO:138; SEQ ID NO:140; SEQ ID NO:142; SEQ ID NO:144; SEQ ID NO:147; SEQ ID NO:151; SEQ ID NO:159; SEQ ID NO:165; SEQ ID NO:172; SEQ ID NO:180; SEQ ID NO:188; SEQ ID NO:194; SEQ ID NO:200; SEQ ID NO:205; SEQ ID NO:211; SEQ ID NO:219; SEQ ID NO:223; SEQ ID NO:230; SEQ ID NO:235; SEQ ID NO:242; SEQ ID NO:249 or SEQ ID NO:255, or the polypeptide encoded by SEQ ID NO:145) can further comprise adjuvants, carriers and the like.

The antibodies can be used in immunoprecipitation, staining, immunoaffinity columns, and the like. If desired, nucleic acid sequences encoding for specific antigens can be generated by immunization followed by isolation of polypeptide or nucleic acid, amplification or cloning and immobilization of polypeptide onto an array of the invention. Alternatively, the methods of the invention can be used to modify the structure of an antibody produced by a cell to be modified, e.g., an antibody's affinity can be increased or decreased. Furthermore, the ability to make or modify antibodies can be a phenotype engineered into a cell by the methods of the invention.

Methods of immunization, producing and isolating antibodies (polyclonal and monoclonal) are known to those of skill in the art and described in the scientific and patent literature, see, e.g., Coligan, CURRENT PROTOCOLS IN IMMUNOLOGY, Wiley/Greene, NY (1991); Stites (eds.) BASIC AND CLINICAL IMMUNOLOGY (7th ed.) Lange Medical Publications, Los Altos, Calif. ("Stites"); Goding, MONOCLONAL ANTIBODIES: PRINCIPLES AND PRACTICE (2d ed.) Academic Press, New York, N.Y. (1986); Kohler (1975) Nature 256:495; Harlow (1988) ANTIBODIES, A LABORATORY MANUAL, Cold Spring Harbor Publications, New York. Antibodies also can be generated in vitro, e.g., using recombinant antibody binding site expressing phage display libraries, in addition to the traditional in vivo methods using animals. See, e.g., Hoogenboom (1997) Trends Biotechnol. 15:62-70; Katz (1997) Annu. Rev. Biophys. Biomol. Struct. 26:27-45.

Polypeptides or peptides can be used to generate antibodies which bind specifically to the polypeptides, e.g., the proteases, of the invention. The resulting antibodies may be used in immunoaffinity chromatography procedures to isolate or purify the polypeptide or to determine whether the polypeptide is present in a biological sample. In such procedures, a protein preparation, such as an extract, or a biological sample is contacted with an antibody capable of specifically binding to one of the polypeptides of the invention.

In immunoaffinity procedures, the antibody is attached to a solid support, such as a bead or other column matrix. The protein preparation is placed in contact with the antibody under conditions in which the antibody specifically binds to one of the polypeptides of the invention. After a wash to remove non-specifically bound proteins, the specifically bound polypeptides are eluted.

The ability of proteins in a biological sample to bind to the antibody may be determined using any of a variety of procedures familiar to those skilled in the art. For example, binding may be determined by labeling the antibody with a detectable label such as a fluorescent agent, an enzymatic label, or a radioisotope. Alternatively, binding of the antibody to the sample may be detected using a secondary antibody having such a detectable label thereon. Particular assays include ELISA assays, sandwich assays, radioimmunoassays, and Western Blots.

Polyclonal antibodies generated against the polypeptides of the invention can be obtained by direct injection of the polypeptides into an animal or by administering the polypeptides to a non-human animal. The antibody so obtained will then bind the polypeptide itself. In this manner, even a sequence encoding only a fragment of the polypeptide can be used to generate antibodies which may bind to the whole native polypeptide. Such antibodies can then be used to isolate the polypeptide from cells expressing that polypeptide.

For preparation of monoclonal antibodies, any technique which provides antibodies produced by continuous cell line cultures can be used. Examples include the hybridoma technique, the trioma technique, the human B-cell hybridoma technique, and the EBV-hybridoma technique (see, e.g., Cole (1985) in Monoclonal Antibodies and Cancer Therapy, Alan R. Liss, Inc., pp. 77-96).

Techniques described for the production of single chain antibodies (see, e.g., U.S. Pat. No. 4,946,778) can be adapted to produce single chain antibodies to the polypeptides of the invention. Alternatively, transgenic mice may be used to express humanized antibodies to these polypeptides or fragments thereof.

Antibodies generated against the polypeptides of the invention may be used in screening for similar polypeptides (e.g., proteases) from other organisms and samples. In such techniques, polypeptides from the organism are contacted with the antibody and those polypeptides which specifically bind the antibody are detected. Any of the procedures described above may be used to detect antibody binding.

Kits

The invention provides kits comprising the compositions, e.g., nucleic acids, expression cassettes, vectors, cells, transgenic seeds or plants or plant parts, polypeptides (e.g., proteases) and/or antibodies of the invention. The kits also can contain instructional material teaching the methodologies and industrial uses of the invention, as described herein.

Whole Cell Engineering and Measuring Metabolic Parameters

The methods of the invention provide whole cell evolution, or whole cell engineering, of a cell to develop a new cell strain having a new phenotype, e.g., a new or modified protease activity, by modifying the genetic composition of the cell. The genetic composition can be modified by addition to the cell of a nucleic acid of the invention, e.g., a coding sequence for an enzyme of the invention. See, e.g., WO0229032; WO0196551.

To detect the new phenotype, at least one metabolic parameter of a modified cell is monitored in the cell in a "real time" or "on-line" time frame. In one aspect, a plurality of cells, such as a cell culture, is monitored in "real time" or "on-line." In one aspect, a plurality of metabolic parameters is monitored in "real time" or "on-line." Metabolic parameters can be monitored using the proteases of the invention.

Metabolic flux analysis (MFA) is based on a known biochemistry framework. A linearly independent metabolic matrix is constructed based on the law of mass conservation and on the pseudo-steady state hypothesis (PSSH) on the intracellular metabolites. In practicing the methods of the invention, metabolic networks are established, including the:

identity of all pathway substrates, products and intermediary metabolites identity of all the chemical reactions interconverting the pathway metabolites, the stoichiometry of the pathway reactions, identity of all the enzymes catalyzing the reactions, the enzyme reaction kinetics, the regulatory interactions between pathway components, e.g. allosteric interactions, enzyme-enzyme interactions etc, intracellular compartmentalization of enzymes or any other supramolecular organization of the enzymes, and, the presence of any concentration gradients of metabolites, enzymes or effector molecules or diffusion barriers to their movement.

Once the metabolic network for a given strain is built, mathematic presentation by matrix notion can be introduced to estimate the intracellular metabolic fluxes if the on-line metabolome data is available. Metabolic phenotype relies on the changes of the whole metabolic network within a cell. Metabolic phenotype relies on the change of pathway utilization with respect to environmental conditions, genetic regulation, developmental state and the genotype, etc. In one aspect of the methods of the invention, after the on-line MFA calculation, the dynamic behavior of the cells, their phenotype and other properties are analyzed by investigating the pathway utilization. For example, if the glucose supply is increased and the oxygen decreased during the yeast fermentation, the utilization of respiratory pathways will be reduced and/or stopped, and the utilization of the fermentative pathways will dominate. Control of physiological state of cell cultures will become possible after the pathway analysis. The methods of the invention can help determine how to manipulate the fermentation by determining how to change the substrate supply, temperature, use of inducers, etc. to control the physiological state of cells to move along desirable direction. In practicing the methods of the invention, the MFA results can also be compared with transcriptome and proteome data to design experiments and protocols for metabolic engineering or gene shuffling, etc.

In practicing the methods of the invention, any modified or new phenotype can be conferred and detected, including new or improved characteristics in the cell. Any aspect of metabolism or growth can be monitored.

Monitoring Expression of an mRNA Transcript

In one aspect of the invention, the engineered phenotype comprises increasing or decreasing the expression of an mRNA transcript (e.g., a protease message) or generating new (e.g., protease) transcripts in a cell. This increased or decreased expression can be traced by testing for the presence of a protease of the invention or by protease activity assays. mRNA transcripts, or messages, also can be detected and quantified by any method known in the art, including, e.g., Northern blots, quantitative amplification reactions, hybridization to arrays, and the like. Quantitative amplification reactions include, e.g., quantitative PCR, including, e.g., quantitative reverse transcription polymerase chain reaction, or RT-PCR; quantitative real time RT-PCR, or "real-time kinetic RT-PCR" (see, e.g., Kreuzer (2001) Br. J. Haematol. 114: 313-318; Xia (2001) Transplantation 72:907-914).

In one aspect of the invention, the engineered phenotype is generated by knocking out expression of a homologous gene. The gene's coding sequence or one or more transcriptional control elements can be knocked out, e.g., promoters or enhancers. Thus, the expression of a transcript can be completely ablated or only decreased.

In one aspect of the invention, the engineered phenotype comprises increasing the expression of a homologous gene. This can be effected by knocking out of a negative control element, including a transcriptional regulatory element acting in cis- or trans-, or, mutagenizing a positive control element. One or more, or, all the transcripts of a cell can be measured by hybridization of a sample comprising transcripts of the cell, or, nucleic acids representative of or complementary to transcripts of a cell, by hybridization to immobilized nucleic acids on an array.

Monitoring Expression of a Polypeptides, Peptides and Amino Acids

In one aspect of the invention, the engineered phenotype comprises increasing or decreasing the expression of a polypeptide (e.g., a protease) or generating new polypeptides in a cell. This increased or decreased expression can be traced by determining the amount of protease present or by protease activity assays. Polypeptides, peptides and amino acids also can be detected and quantified by any method known in the art, including, e.g., nuclear magnetic resonance (NMR), spectrophotometry, radiography (protein radiolabeling), electrophoresis, capillary electrophoresis, high performance liquid chromatography (HPLC), thin layer chromatography (TLC), hyperdiffusion chromatography, various immunological methods, e.g. immunoprecipitation, immunodiffusion, immuno-electrophoresis, radioimmunoassays (RIAs), enzyme-linked immunosorbent assays (ELISAs), immunofluorescent assays, gel electrophoresis (e.g., SDS-PAGE), staining with antibodies, fluorescent activated cell sorter (FACS), pyrolysis mass spectrometry, Fourier-Transform Infrared Spectrometry, Raman spectrometry, GC-MS, and LC-Electrospray and cap-LC-tandem-electrospray mass spectrometries, and the like. Novel bioactivities can also be screened using methods, or variations thereof, described in U.S. Pat. No. 6,057,103. Furthermore, as discussed below in detail, one or more, or, all the polypeptides of a cell can be measured using a protein array.

Industrial Applications

Detergent Compositions

The invention provides detergent compositions comprising one or more polypeptides (e.g., proteases) of the invention, and methods of making and using these compositions. The invention incorporates all methods of making and using detergent compositions, see, e.g., U.S. Pat. Nos. 6,413,928; 6,399,561; 6,365,561; 6,380,147. The detergent compositions can be a one and two part aqueous composition, a non-aqueous liquid composition, a cast solid, a granular form, a particulate form, a compressed tablet, a gel and/or a paste and a slurry form. The proteases of the invention can also be used as a detergent additive product in a solid or a liquid form. Such additive products are intended to supplement or boost the performance of conventional detergent compositions and can be added at any stage of the cleaning process.

The invention also provides methods capable of removing gross food soils, films of food residue and other minor food compositions using these detergent compositions. Proteases of the invention can facilitate the removal of stains by means of catalytic hydrolysis of proteins. Proteases of the invention can be used in dishwashing detergents in textile laundering detergents.

The actual active enzyme content depends upon the method of manufacture of a detergent composition and is not critical, assuming the detergent solution has the desired enzymatic activity. In one aspect, the amount of protease present in the final solution ranges from about 0.001 mg to 0.5 mg per gram of the detergent composition. The particular enzyme chosen for use in the process and products of this invention depends upon the conditions of final utility, including the physical product form, use pH, use temperature, and soil types to be degraded or altered. The enzyme can be chosen to provide optimum activity and stability for any given set of utility conditions. In one aspect, the proteases of the present invention are active in the pH ranges of from about 4 to about 12 and in the temperature range of from about 20° C. to about 95° C. The detergents of the invention can comprise cationic, semi-polar nonionic or zwitterionic surfactants; or, mixtures thereof.

Proteases of the invention can be formulated into powdered and liquid detergents having pH between 4.0 and 12.0 at levels of about 0.01 to about 5% (preferably 0.1% to 0.5%) by weight. These detergent compositions can also include other enzymes such as proteases, cellulases, lipases or endoglycosidases, endo-beta-1,4-glucanases, beta-glucanases, endo-beta-1,3(4)-glucanases, cutinases, peroxidases, laccases, amylases, glucoamylases, pectinases, reductases, oxidases, phenoloxidases, ligninases, pullulanases, arabinanases, hemicellulases, mannanases, xyloglucanases, xylanases, pectin acetyl esterases, rhamnogalacturonan acetyl esterases, polygalacturonases, rhamnogalacturonases, galactanases, pectin lyases, pectin methylesterases, cellobiohydrolases and/or transglutaminases. These detergent compositions can also include builders and stabilizers.

The addition of proteases of the invention to conventional cleaning compositions does not create any special use limitation. In other words, any temperature and pH suitable for the detergent is also suitable for the compositions of the invention as long as the enzyme is active at or tolerant of the pH and/or temperature of the intended use. In addition, the proteases of the invention can be used in a cleaning composition without detergents, again either alone or in combination with builders and stabilizers.

The present invention provides cleaning compositions including detergent compositions for cleaning hard surfaces, detergent compositions for cleaning fabrics, dishwashing compositions, oral cleaning compositions, denture cleaning compositions, and contact lens cleaning solutions.

In one aspect, the invention provides a method for washing an object comprising contacting the object with a polypeptide of the invention under conditions sufficient for washing. A protease of the invention may be included as a detergent additive. The detergent composition of the invention may, for example, be formulated as a hand or machine laundry detergent composition comprising a polypeptide of the invention. A laundry additive suitable for pre-treatment of stained fabrics can comprise a polypeptide of the invention. A fabric softener composition can comprise a protease of the invention. Alternatively, a protease of the invention can be formulated as a detergent composition for use in general household hard surface cleaning operations. In alternative aspects, detergent additives and detergent compositions of the invention may comprise one or more other enzymes such as a protease, a lipase, a cutinase, another protease, a carbohydrase, a cellulase, a pectinase, a mannanase, an arabinase, a galactanase, a xylanase, an oxidase, e.g., a lactase, and/or a peroxidase (see also, above). The properties of the enzyme(s) of the invention are chosen to be compatible with the selected detergent (i.e. pH-optimum, compatibility with other enzymatic and non-enzymatic ingredients, etc.) and the enzyme(s) is present in effective amounts. In one aspect, protease enzymes of the invention are used to remove malodorous materials from fabrics. Various detergent compositions and methods for making them that can be used in practicing the invention are described in, e.g., U.S. Pat. Nos. 6,333,301; 6,329,333; 6,326,341; 6,297,038; 6,309,871; 6,204,232; 6,197,070; 5,856,164.

When formulated as compositions suitable for use in a laundry machine washing method, the proteases of the invention can comprise both a surfactant and a builder compound. They can additionally comprise one or more detergent components, e.g., organic polymeric compounds, bleaching agents, additional enzymes, suds suppressors, dispersants, lime-soap dispersants, soil suspension and anti-redeposition agents and corrosion inhibitors. Laundry compositions of the invention can also contain softening agents, as additional detergent components. Such compositions containing carbohydrase can provide fabric cleaning, stain removal, whiteness maintenance, softening, color appearance, dye transfer inhibition and sanitization when formulated as laundry detergent compositions.

The density of the laundry detergent compositions of the invention can range from about 200 to 1500 g/liter, or, about 400 to 1200 g/liter, or, about 500 to 950 g/liter, or, 600 to 800 g/liter, of composition; this can be measured at about 20° C.

The "compact" form of laundry detergent compositions of the invention is best reflected by density and, in terms of composition, by the amount of inorganic filler salt. Inorganic filler salts are conventional ingredients of detergent compositions in powder form. In conventional detergent compositions, the filler salts are present in substantial amounts, typically 17% to 35% by weight of the total composition. In one aspect of the compact compositions, the filler salt is present in amounts not exceeding 15% of the total composition, or, not exceeding 10%, or, not exceeding 5% by weight of the composition. The inorganic filler salts can be selected from the alkali and alkaline-earth-metal salts of sulphates and chlorides, e.g., sodium sulphate.

Liquid detergent compositions of the invention can also be in a "concentrated form." In one aspect, the liquid detergent compositions can contain a lower amount of water, compared to conventional liquid detergents. In alternative aspects, the water content of the concentrated liquid detergent is less than 40%, or, less than 30%, or, less than 20% by weight of the detergent composition. Detergent compounds of the invention can comprise formulations as described in WO 97/01629.

Proteases, such as metalloproteases (MPs) and serine proteases, of the invention can be useful in formulating various cleaning compositions. A number of known compounds are suitable surfactants including nonionic, anionic, cationic, or zwitterionic detergents, can be used, e.g., as disclosed in U.S. Pat. Nos. 4,404,128; 4,261,868; 5,204,015. In addition, proteases can be used, for example, in bar or liquid soap applications, dish care formulations, contact lens cleaning solutions or products, peptide hydrolysis, waste treatment, textile applications, as fusion-cleavage enzymes in protein production, and the like. Proteases may provide enhanced performance in a detergent composition as compared to another detergent protease, that is, the enzyme group may increase cleaning of certain enzyme sensitive stains such as grass or blood, as determined by usual evaluation after a standard wash cycle. Metalloproteases, serine proteases (or other proteases of the invention) can be formulated into known powdered and liquid detergents having pH between 6.5 and 12.0 at levels of about 0.01 to about 5% (for example, about 0.1% to 0.5%) by weight. These detergent cleaning compositions can also include other enzymes such as known proteases, amylases, cellulases, lipases or endoglycosidases, as well as builders and stabilizers.

Treating Fibers and Textiles

The invention provides methods of treating fibers and fabrics using one or more proteases of the invention. The proteases can be used in any fiber- or fabric-treating method, which are well known in the art, see, e.g., U.S. Pat. Nos. 6,261,828; 6,077,316; 6,024,766; 6,021,536; 6,017,751; 5,980,581; US Patent Publication No. 20020142438 A1. For example, proteases of the invention can be used in fiber and/or fabric desizing. In one aspect, the feel and appearance of a fabric is improved by a method comprising contacting the fabric with a protease of the invention in a solution. In one aspect, the fabric is treated with the solution under pressure. For example, proteases of the invention can be used in the removal of stains.

In one aspect, proteases of the invention are applied during or after the weaving of textiles, or during the desizing stage, or one or more additional fabric processing steps. During the weaving of textiles, the threads are exposed to considerable mechanical strain. Prior to weaving on mechanical looms, warp yarns are often coated with sizing starch or starch derivatives in order to increase their tensile strength and to prevent breaking. The proteases of the invention can be applied to remove these sizing starch or starch derivatives. After the textiles have been woven, a fabric can proceed to a desizing stage. This can be followed by one or more additional fabric processing steps. Desizing is the act of removing "size" from textiles. After weaving, the size coating must be removed before further processing the fabric in order to ensure a homogeneous and wash-proof result. The invention provides a method of desizing comprising enzymatic treatment of the "size" by the action of proteases of the invention.

The enzymes of the invention can be used to desize fabrics, including cotton-containing fabrics, as detergent additives, e.g., in aqueous compositions. The invention provides methods for producing a stonewashed look on indigo-dyed denim fabric and garments. For the manufacture of clothes, the fabric can be cut and sewn into clothes or garments. These can be finished before or after the treatment. In particular, for the manufacture of denim jeans, different enzymatic finishing methods have been developed. The finishing of denim garment normally is initiated with an enzymatic desizing step, during which garments are subjected to the action of amylolytic enzymes in order to provide softness to the fabric and make the cotton more accessible to the subsequent enzymatic finishing steps. The invention provides methods of finishing denim garments (e.g., a "bio-stoning process"), enzymatic desizing and providing softness to fabrics using the proteases of the invention. The invention provides methods for quickly softening denim garments in a desizing and/or finishing process.

Other enzymes can be also be used in these desizing processes. For example, an alkaline and thermostable amylase and protease can be combined in a single bath for desizing and bioscouring. Among advantages of combining desizing and scouring in one step are cost reduction and lower environmental impact due to savings in energy and water usage and lower waste production. Exemplary application conditions for desizing and bioscouring are about pH 8.5 to 10.0 and temperatures of about 40° C. and up. Using a protease of the invention, low enzyme dosages, e.g., about 100 grams (g) per a ton of cotton, and short reaction times, e.g., about 15 minutes, can be used to obtain efficient desizing and scouring with out added calcium.

In one aspect, an alkaline and thermostable amylase and protease are combined in a single bath desizing and bioscouring. Among advantages of combining desizing and scouring in one step are cost reduction and lower environmental impact due to savings in energy and water usage and lower waste production. Application conditions for desizing and bioscouring can be between about pH 8.5 to pH 10.0 and temperatures at about 40° C. and up. Low enzyme dosages (e.g., about 100 g per a ton of cotton) and short reaction times (e.g., about 15 minutes) can be used to obtain efficient desizing and scouring with out added calcium.

The proteases of the invention can be used in combination with other carbohydrate degrading enzymes, e.g., cellulase, arabinase, xyloglucanase, pectinase, and the like, for the preparation of fibers or for cleaning of fibers. These can be used in combination with detergents. In one aspect, proteases of the invention can be used in treatments to prevent the graying of a textile.

The proteases of the invention can be used to treat any cellulosic material, including fibers (e.g., fibers from cotton, hemp, flax or linen), sewn and unsewn fabrics, e.g., knits, wovens, denims, yarns, and toweling, made from cotton, cotton blends or natural or manmade cellulosics (e.g. originating from xylan-containing cellulose fibers such as from wood pulp) or blends thereof. Examples of blends are blends of cotton or rayon/viscose with one or more companion material such as wool, synthetic fibers (e.g. polyamide fibers, acrylic fibers, polyester fibers, polyvinyl alcohol fibers, polyvinyl chloride fibers, polyvinylidene chloride fibers, polyurethane fibers, polyurea fibers, aramid fibers), and cellulose-containing fibers (e.g. rayon/viscose, ramie, hemp, flax/linen, jute, cellulose acetate fibers, lyocell).

The textile treating processes of the invention (using proteases of the invention) can be used in conjunction with other textile treatments, e.g., scouring and bleaching. Scouring is the removal of non-cellulosic material from the cotton fiber, e.g., the cuticle (mainly consisting of waxes) and primary cell wall (mainly consisting of pectin, protein and xyloglucan). A proper wax removal is necessary for obtaining a high wettability. This is needed for dyeing. Removal of the primary cell walls by the processes of the invention improves wax removal and ensures a more even dyeing. Treating textiles with the processes of the invention can improve whiteness in the bleaching process. The main chemical used in scouring is sodium, hydroxide in high concentrations and at high temperatures. Bleaching comprises oxidizing the textile. Bleaching typically involves use of hydrogen peroxide as the oxidizing agent in order to obtain either a fully bleached (white) fabric or to ensure a clean shade of the dye.

The invention also provides alkaline proteases (proteases active under alkaline conditions). These have wide-ranging applications in textile processing, degumming of plant fibers (e.g., plant bast fibers), treatment of pectic wastewaters, paper-making, and coffee and tea fermentations. See, e.g., Hoondal (2002) Applied Microbiology and Biotechnology 59:409-418.

Treating Foods and Food Processing

The proteases of the invention have numerous applications in food processing industry. For example, in one aspect, the proteases of the invention are used to improve the extraction of oil from oil-rich plant material, e.g., oil-rich seeds, for example, soybean oil from soybeans, olive oil from olives, rapeseed oil from rapeseed and/or sunflower oil from sunflower seeds.

The proteases of the invention can be used for separation of components of plant cell materials. For example, proteases of the invention can be used in the separation of protein-rich material (e.g., plant cells) into components, e.g., sucrose from sugar beet or starch or sugars from potato, pulp or hull fractions. In one aspect, proteases of the invention can be used to separate protein-rich or oil-rich crops into valuable protein and oil and hull fractions. The separation process may be performed by use of methods known in the art.

The proteases of the invention can be used in the preparation of fruit or vegetable juices, syrups, extracts and the like to increase yield. The proteases of the invention can be used in the enzymatic treatment (e.g., hydrolysis of proteins) of various plant cell wall-derived materials or waste materials, e.g. from wine or juice production, or agricultural residues such as vegetable hulls, bean hulls, sugar beet pulp, olive pulp, potato pulp, and the like. The proteases of the invention can be used to modify the consistency and appearance of processed fruit or vegetables. The proteases of the invention can be used to treat plant material to facilitate processing of plant material, including foods, facilitate purification or extraction of planet components. The proteases of the invention can be used to improve feed value, decrease the water binding capacity, improve the degradability in waste water plants and/or improve the conversion of plant material to ensilage, and the like.

Animal Feeds and Food or Feed Additives

The invention provides methods for treating animal feeds and foods and food or feed additives using proteases of the invention, animals including mammals (e.g., humans), birds, fish and the like. The invention provides animal feeds, foods, and additives comprising proteases of the invention. In one aspect, treating animal feeds, foods and additives using proteases of the invention can help in the availability of nutrients, e.g., starch, in the animal feed or additive. By breaking down difficult to digest proteins or indirectly or directly unmasking starch (or other nutrients), the protease makes nutrients more accessible to other endogenous or exogenous enzymes. The protease can also simply cause the release of readily digestible and easily absorbed nutrients and sugars.

Proteases of the present invention, in the modification of animal feed or a food, can process the food or feed either in vitro (by modifying components of the feed or food) or in vivo. Proteases can be added to animal feed or food compositions containing high amounts of arabinogalactans or galactans, e.g. feed or food containing plant material from soy bean, rape seed, lupin and the like. When added to the feed or food the protease significantly improves the in vivo breakdown of plant cell wall material, whereby a better utilization of the plant nutrients by the animal (e.g., human) is achieved. In one aspect, the growth rate and/or feed conversion ratio (i.e. the weight of ingested feed relative to weight gain) of the animal is improved. For example a partially or indigestible galactan-comprising protein is fully or partially degraded by a protease of the invention, e.g. in combination with another enzyme, e.g., beta-galactosidase, to peptides and galactose and/or galactooligomers. These enzyme digestion products are more digestible by the animal. Thus, proteases of the invention can contribute to the available energy of the feed or food. Also, by contributing to the degradation of galactan-comprising proteins, a protease of the invention can improve the digestibility and uptake of carbohydrate and non-carbohydrate feed or food constituents such as protein, fat and minerals.

In another aspect, protease of the invention can be supplied by expressing the enzymes directly in transgenic feed crops (as, e.g., transgenic plants, seeds and the like), such as corn, soy bean, rape seed, lupin and the like. As discussed above, the invention provides transgenic plants, plant parts and plant cells comprising a nucleic acid sequence encoding a polypeptide of the invention. In one aspect, the nucleic acid is expressed such that the protease of the invention is produced in recoverable quantities. The protease can be recovered from any plant or plant part. Alternatively, the plant or plant part containing the recombinant polypeptide can be used as such for improving the quality of a food or feed, e.g., improving nutritional value, palatability, and rheological properties, or to destroy an antinutritive factor.

Paper or Pulp Treatment

The proteases of the invention can be in paper or pulp treatment or paper deinking. For example, in one aspect, the invention provides a paper treatment process using proteases of the invention. In another aspect, paper components of recycled photocopied paper during chemical and enzymatic deinking processes. In one aspect, proteases of the invention can be used in combination with cellulases, pectate lyases or other enzymes. The paper can be treated by the following three processes: 1) disintegration in the presence of proteases of the invention, 2) disintegration with a deinking chemical and proteases of the invention, and/or 3) disintegration after soaking with proteases of the invention. The recycled paper treated with proteases can have a higher brightness due to removal of toner particles as compared to the paper treated with just cellulase. While the invention is not limited by any particular mechanism, the effect of proteases of the invention may be due to its behavior as surface-active agents in pulp suspension.

The invention provides methods of treating paper and paper pulp using one or more proteases of the invention. The proteases of the invention can be used in any paper- or pulp-treating method, which are well known in the art, see, e.g., U.S. Pat. Nos. 6,241,849; 6,066,233; 5,582,681. For example, in one aspect, the invention provides a method for deinking and decolorizing a printed paper containing a dye, comprising pulping a printed paper to obtain a pulp slurry, and dislodging an ink from the pulp slurry in the presence of proteases of the invention (other enzymes can also be added). In another aspect, the invention provides a method for enhancing the freeness of pulp, e.g., pulp made from secondary fiber, by adding an enzymatic mixture comprising proteases of the invention (can also include other enzymes, e.g., pectate lyase, cellulase, amylase or glucoamylase enzymes) to the pulp and treating under conditions to cause a reaction to produce an enzymatically treated pulp. The freeness of the enzymatically treated pulp is increased from the initial freeness of the secondary fiber pulp without a loss in brightness.

Waste Treatment

The proteases of the invention can be used in a variety of other industrial applications, e.g., in waste treatment. For example, in one aspect, the invention provides a solid waste digestion process using proteases of the invention. The methods can comprise reducing the mass and volume of substantially untreated solid waste. Solid waste can be treated with an enzymatic digestive process in the presence of an enzymatic solution (including proteases of the invention) at a controlled temperature. This results in a reaction without appreciable bacterial fermentation from added microorganisms. The solid waste is converted into a liquefied waste and any residual solid waste. The resulting liquefied waste can be separated from said any residual solidified waste. See e.g., U.S. Pat. No. 5,709,796.

In addition, the proteases of the invention can be used in the animal rendering industry, to e.g., get rid of feathers, e.g., as described by Yamamura (2002) Biochem. Biophys. Res. Com. 294:1138-1143. Alkaline proteases can also be used in the production of proteinaceous fodder from waste feathers or keratin-containing materials, e.g., as described by Gupta (2002) Appl. Microbiol. Biotechnol. 59:15-32.

Oral Care Products

The invention provides oral care product comprising proteases of the invention. Exemplary oral care products include toothpastes, dental creams, gels or tooth powders, odontics, mouth washes, pre- or post brushing rinse formulations, chewing gums, lozenges, or candy. See, e.g., U.S. Pat. No. 6,264,925.

Brewing and Fermenting

The invention provides methods of brewing (e.g., fermenting) beer comprising proteases of the invention. In one exemplary process, starch-containing raw materials are disintegrated and processed to form a malt. A protease of the invention is used at any point in the fermentation process. For example, proteases of the invention can be used in the processing of barley malt. The major raw material of beer brewing is barley malt. This can be a three stage process. First, the barley grain can be steeped to increase water content, e.g., to around about 40%. Second, the grain can be germinated by incubation at 15 to 25° C. for 3 to 6 days when enzyme synthesis is stimulated under the control of gibberellins. In one aspect, proteases of the invention are added at this (or any other) stage of the process. The action of proteases results in an increase in fermentable reducing sugars. This can be expressed as the diastatic power, DP, which can rise from around 80 to 190 in 5 days at 12° C. Proteases of the invention can be used in any beer or alcoholic beverage producing process, as described, e.g., in U.S. Pat. Nos. 5,762,991; 5,536,650; 5,405,624; 5,021,246; 4,788,066.

Medical and Research Applications

Proteases of the invention can be used for cell isolation from tissue for cellular therapies in the same manner that collagenases. For example, metallo-endoproteinases and other enzymes of the invention that can cleave collagen into smaller peptide fragments, can be used as "liberase enzymes" for tissue dissociation and to improve the health of isolated cells. "Liberase enzymes" can replace traditional collagenase. Proteases of the invention having collagenase I, collagenase II, clostripain and/or neutral protease activity can be used for tissue dissociation. In one aspect, for tissue dissociation, collagenase isoforms of the invention are blended with each other, and, optionally, with a neutral protease. In one aspect, the neutral protease is a neutral protease dispase and/or the neutral protease thermolysin.

Additionally, proteases of the invention can be used as antimicrobial agents, due to their bacteriolytic properties, as described, e.g., in Li, S. et. al. Bacteriolytic Activity and Specificity of *Achromobacter* b-Lytic Protease, J. Biochem. 124, 332-339 (1998).

Proteases of the invention can also be used therapeutically to cleave and destroy specific proteins. Potential targets include toxin proteins, such as Anthrax, *Clostridium botulinum*, Ricin, and essential viral or cancer cell proteins.

Proteases of the invention can also be used in disinfectants, as described, e.g., in J. Gen Microbiol (1991) 137(5): 1145-1153; Science (2001) 249:2170-2172.

Additional medical uses of the proteases of the invention include lipoma removal, wound debraidment and scar prevention (collagenases), debriding chronic dermal ulcers and severely burned areas.

Proteases of the invention can be used to in sterile enzymatic debriding compositions, e.g., ointments, in one aspect, containing about 250 collagenase units per gram. White petrolatum USP can be a carrier. In one aspect, proteases of the invention can be used in indications similar to Santyl® Ointment (BTC, Lynbrook, N.Y.). Proteases of the invention can also be used in alginate dressings, antimicrobial barrier dressings, burn dressings, compression bandages, diagnostic tools, gel dressings, hydro-selective dressings, hydrocellular (foam) dressings, hydrocolloid Dressings, I.V dressings, incise drapes, low adherent dressings, odor absorbing dressings, paste bandages, post operative dressings, scar management, skin care, transparent film dressings and/or wound closure. Proteases of the invention can be used in wound cleansing, wound bed preparation, to treat pressure ulcers, leg ulcers, burns, diabetic foot ulcers, scars, IV fixation, surgical wounds and minor wounds.

Additionally, proteases of the invention can be used in proteomics and lab work in general. For instance, proteases can be used in the same manner as DNA restriction enzymes.

Other Industrial Applications

The invention also includes a method of increasing the flow of production fluids from a subterranean formation by removing a viscous, protein-containing, damaging fluid formed during production operations and found within the subterranean formation which surrounds a completed well bore comprising allowing production fluids to flow from the well bore; reducing the flow of production fluids from the formation below expected flow rates; formulating an enzyme treatment by blending together an aqueous fluid and a polypeptide of the invention; pumping the enzyme treatment to a desired location within the well bore; allowing the enzyme treatment to degrade the viscous, protein-containing, damaging fluid, whereby the fluid can be removed from the subterranean formation to the well surface; and wherein the enzyme treatment is effective to attack protein in cell walls.

Proteases of the invention can be used for peptide synthesis, in the leather industry, e.g., for hide processing, e.g., in hair removal and/or bating, for waste management, e.g., removal of hair from drains, in the photography industry, e.g., for silver recovery from film, in the medical industry, e.g., as discussed above, e.g., for treatment of burns, wounds, carbuncles, furuncles and deep abscesses or to dissolve blood clots by dissolving fibrin, for silk degumming.

In other aspects, proteases of the invention can be used as flavor enhancers in, for example, cheese and pet food, as described, e.g., in Pommer, K., Investigating the impact of enzymes on pet food palatability, Petfood Industry, May 2002, 10-11.

In yet another embodiment of the invention, proteases of the invention can be used to increase starch yield from corn wet milling, as described, e.g., in Johnston, D. B., and Singh, V. Use of proteases to Reduce Steep Time and SO2 requirements in a corn wet-milling process, Cereal Chem. 78(4): 405-411.

In other aspects, proteases of the invention can be used in biodefense (e.g., destruction of spores or bacteria). Use of proteases in biodefense applications offer a significant benefit, in that they can be very rapidly developed against any currently unknown biological warfare agents of the future. In addition, proteases of the invention can be used for decontamination of affected environments.

Additionally, proteases of the invention can be used in biofilm degradation, in biomass conversion to ethanol, and/or in the personal care and cosmetics industry.

Proteases of the invention can also be used to enhance enantioselectivity, as described, e.g., in Arisawa, A. et. al. *Streptomyces* Serine Protease (DHP-A) as a New Biocatalyst Capable of Forming Chiral Intermediates of 1,4-Dihydropyridine Calcium Antagonists. Appl Environ Microbiol 2002 June; 68(6):2716-2725; Haring, D. et. al. Semisynthetic Enzymes in Asymmetric Synthesis: Enantioselective Reduction of Racemic Hydroperoxides Catalyzed by Seleno-Subtilisin. J. Org. Chem. 1999, 64:832-835.

The invention will be further described with reference to the following examples; however, it is to be understood that the invention is not limited to such examples.

EXAMPLES

Example 1

Protease Activity Assays

The following example describes exemplary protease activity assays to determine the catalytic activity of a protease. These exemplary assays can be used to determine if a polypeptide is within the scope of the invention.

The activity assays used for proteinases (active on proteins) include zymograms and liquid substrate enzyme assays. Three different types of zymograms were used to measure activity: casein, gelatin and zein. For the liquid substrate enzyme assays, three main types were used: gel electrophoresis, O-phthaldialdehyde (OPA), and fluorescent end point assays. For both the gel electrophoresis and OPA assays, four different substrates were used: zein, Soybean Trypsin Inhibitor (SBTI, SIGMA-Aldrich, T6522), wheat germ lectin and soybean lectin. The substrate for the fluorescent end point assay was gelatin.

The activity assays used for proteinases and peptidases (active on peptides) used pNA linked small peptide substrates. The assays included specificity end point assays, unit definition kinetic assays and pH assays.

The following example describes the above-mentioned exemplary protease activity assays. These exemplary assays can be used to determine if a polypeptide is within the scope of the invention.

Protein (Proteinase Activity)

Casein Zymogram Gel Assays

Casein zymogram gels were used to assess proteinase activity (see Tables 1 and 2). The protease activity assays were assessed using 4-16% gradient gels (Invitrogen Corp., Carlsbad, Calif.) containing casein conjugated to a blue dye and embedded within the gel matrix. All zymogram gels were processed according to the manufacturer's instructions. Briefly, each sample was mixed with an equal volume of 2× loading dye and incubated without heating for ten minutes before loading. After electrophoresis, gels were incubated in a renaturing buffer to remove the SDS and allow the proteins to regain their native form. Gels were then transferred to a developing solution and incubated at 37° C. for 4 to 24 hours. If a protease digests the casein in the gel, a clear zone is produced against the otherwise blue background that corresponds to the location of the protease in the gel. Negative controls (indicated with NC on gel images) were processed along with the experimental samples in each experiment and electrophoresed on the casein zymograms next to their corresponding protease(s).

Unlike traditional SDS-PAGE, samples are not heat denatured prior to electrophoresis of casein zymograms. As a result, it is sometimes difficult to accurately assess the molecular weight of the proteases. For example, Subtilisin A (Sigma, P5380, indicated with Subt.A on the gel images), which was used as a positive control in these experiments, is predicted to be approximately 27 kDa in size. However, when electrophoresed through casein zymograms using the conditions described, Subtilisin A barely migrates into the gel and is visible only above 183 kDa. Therefore, the zymograms do not define the MW of the proteases indicated, but rather used as an indicator of activity.

Gelatin Zymogram Assays

Gelatin zymograms, Novex® Zymogram Gels, were performed according to manufacturer's instructions (Invitrogen Corp., Carlsbad, Calif.). Unlike the casein zymograms, gelatin zymograms were post-stained following development using either a Colloidal Blue Staining Kit or the SIMPLY-BLUE™ Safestain, (both from Invitrogen). Areas of protease activity appeared as clear bands against a dark background.

Corn Zein Assays

Corn zein was used as substrate for protease activity assays, using powder, Z-3625 (Sigma Chemical Co. St. Louis, Mo.), and Aquazein, 10% solution (Freeman Industries, Tuckahoe, N.Y.). When fractionated through a SDS-PAGE gel, zein from both suppliers produced bands of 24 and 22 kDa. The two zein bands correspond in molecular weight to those previously described for alpha-zein, the most abundant subclass of zeins, which are estimated to comprise 71-84% of total zein in corn (see, e.g., Consoli (2001) Electrophoresis 22:2983-2989). Results are illustrated in Table 3, above.

Lyophilized culture supernatants containing active protease were resuspended, dialyzed, and incubated with zein in 50 mM $KPO_4$, pH 7.5. Reactions were run in a 96-well microtiter format. "Substrate only" and "enzyme preparation only" controls were processed as well as experimental samples. After 24 hours at 30° C., aliquots were removed and subjected to OPA, SDS-PAGE, or Zymogram analysis. In some cases, fresh aliquots were removed and analyzed after 48 or 72 hours at 30° C.

Zein Zymogram: Aquazein was added to a final concentration of 0.075% in a 10% polyacrylamide gel. Aliquots of dialyzed protease samples were electrophoresed through the zein zymogram using standard conditions. Following electrophoresis, the zymogram gel was washed, incubated in a renaturing buffer, incubated overnight in a developing buffer optimized for protease activity (contains NaCl, $CaCl_2$, and Brij 35, in Tris buffer pH 8), and stained with Coomassie blue stain.

SDS-PAGE: Aliquots of equal volume were removed from each sample and subjected to SDS-PAGE analysis. Following electrophoresis, proteins in the gels were stained with SYPRO Orange (Molecular Probes) and visualized using UV transillumination.

OPA: In the presence of Beta-mercaptoethanol (BME), OPA reacts with free amino ends to produce a fluorescent imidazole that can be detected using a standard fluorescence plate reader. In this assay, aliquots of equal volume were removed from each sample and placed in a black fluorescence plate. Samples were then diluted 1:10 in OPA reagents. Fluorescence (Ex=340 nm, Em=450 nm) was determined after a 5-minute incubation. A summary of OPA data on all substrates is included in Table 3, above.

Soybean Trypsin Inhibitor Assays

Soybean Trypsin Inhibitor (SBTI, SIGMA-Aldrich, T6522) was used as a substrate for protease activity. Lyophilized culture supernatants containing active protease were resuspended, dialyzed, and incubated with SBTI (1 mg/ml final conc.) at 37° C. in 50 mM $KPO_4$, pH 7.5. Substrate alone and enzyme preparation alone controls were processed along with experimental samples. After 24 hours, aliquots were removed and subjected to OPA and SDS-PAGE analysis. Results are illustrated in Table 3, above. SDS-PAGE: for SBTI, following electrophoresis, proteins in the gels were stained with Coomassie blue.

Wheat Germ Lectin Assays

Wheat germ lectin (WGA, EY Laboratories, L-2101, Pure) was used as a substrate for protease activity. Lyophilized culture supernatants containing active protease were resuspended, dialysed, and incubated with WGA (1 mg/ml final concentration) at 37° C. in 50 mM $KPO_4$, pH 7.5. Substrate alone and enzyme preparation alone controls were processed along with experimental samples. After 24 hours, aliquots were removed and subjected to OPA and SDS-PAGE analysis as. Results are illustrated in Table 3, above. SDS-PAGE: for WGA, following electrophoresis, proteins in the gels were stained with Coomassie blue.

Soybean Lectin Assays

Soybean lectin (SBA, EY Laboratories, L-1300, Crude) was used as a substrate for protease activity. Lyophilized culture supernatants containing active protease were resuspended, dialysed, and incubated with SBA (1 mg/ml final concentration) at 37° C. in 50 mM $KPO_4$, pH 7.5. Substrate alone and enzyme preparation alone controls were processed along with experimental samples. After 24 hours, aliquots were removed and subjected to OPA and SDS-PAGE analysis. Results are illustrated in Table 3, above. SDS-PAGE: for SBA, following electrophoresis, proteins in the gels were stained with Coomassie blue.

Gelatin in Fluorescent Liquid Endpoint Assay

DQ Gelatin (Molecular Probes, fluorescein conjugate, D-12054) was used to assess the proteolytic activity of the proteases of the invention. DQ gelatin is a protein that is so heavily labeled with a fluorophore that its fluorescence is quenched when the molecule is intact. Proteases that cleave the substrate will release the fluorophores from internal quenching and fluorescence will increase in proportion to the protease activity. DQ Gelatin was diluted to a final concentration of 25 ug/ml in 100 ul reactions containing a suitable buffer such as zymogram developing buffer (Invitrogen) and varying amounts of protease preparations. Reactions were incubated in a 384 well, clear, flat-bottom microtiter plate at 37° C. for various time periods from 1 hr to overnight. Fluorescence was monitored using a fluorescence plate reader after incubation at 37° C. for various times.

Figure 5:
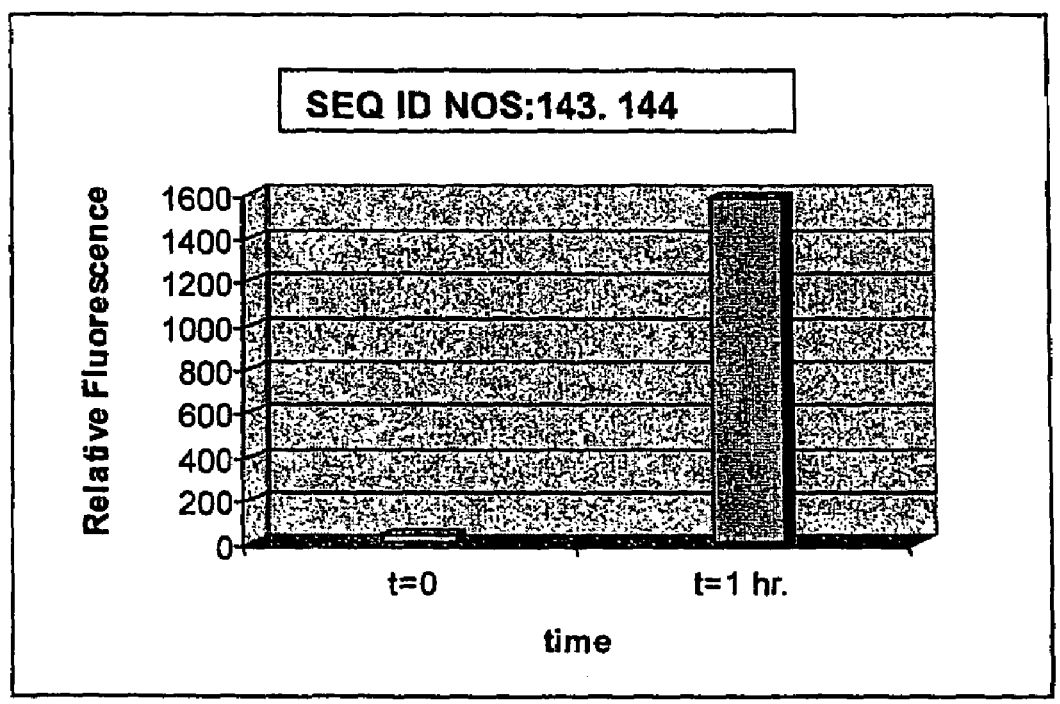
FIG. 5 is a an illustration of results of testing SEQ ID NO:144 (encoded by SEQ ID NO:143) in a gelatin in fluorescent liquid end point assay, as described in detail in Example 1, below.

As an example of the results obtained from the fluorescent liquid end point assay, see Table 5 and FIG. 5, which show the activity of SEQ ID NO:144 (encoded by SEQ ID NO:143). Samples were assayed in duplicate and the raw data is shown in the Table 4, below. Duplicates were averaged and the background from the negative control was subtracted to depict the increase in fluorescence caused by SEQ ID NO:144 activity in one hour using a bar graph (FIG. 5).

TABLE 5

|  | t = 0 | t = 0 | 1 hour | 1 hour |
|---|---|---|---|---|
| SEQ ID NOS: 143, 144 | 1759 | 1819 | 3660 | 3459 |
| Negative Control | 1708 | 1785 | 1888 | 2069 |

Peptides (Proteinase and Peptidase Activity)

Specificity Endpoint Assay

Synthetic small peptide substrates linked to a chromophore are often used to determine the specificity and aid in biochemical characterization of proteases. To gauge the substrate specificity of the proteases of the invention, several para-nitroanilide linked synthetic peptides were obtained from Sigma including Ala-Ala-Pro-Phe-pNA (AAPF), Ala-Ala-Ala-pNA (AAA), N-Bz-D,L-Arg-pNA (BAPNA), Gly-Gly-Phe-pNA, Ile-Glu-Gly-Arg-pNA, and Pro-Phe-Arg-pNA. When the peptide bond between the pNA group and the amino acid in the P1 substrate position is cleaved, a yellow color is produced whose absorbance can be measured at 410 nm. 25 mM stocks of small peptide substrates were prepared in DMSO. Substrates were used at a final concentration of 250 uM in 100 ul reaction volumes including varying amounts of protease preparations. Reactions were run in a suitable protease buffer such as 1× Zymogram developing buffer from Invitrogen and were incubated in a 384 well, clear, flat-bottom microtiter plate at 37° C. for various time periods from 1 hr to overnight. This "end point" assay provides a qualitative instead of quantitative method to assess substrate specificity. However, the process can be adapted to provide qualitative data by determining initial rates for the various small peptide substrates.

Unit Definition Kinetic Assay

Figure 6:
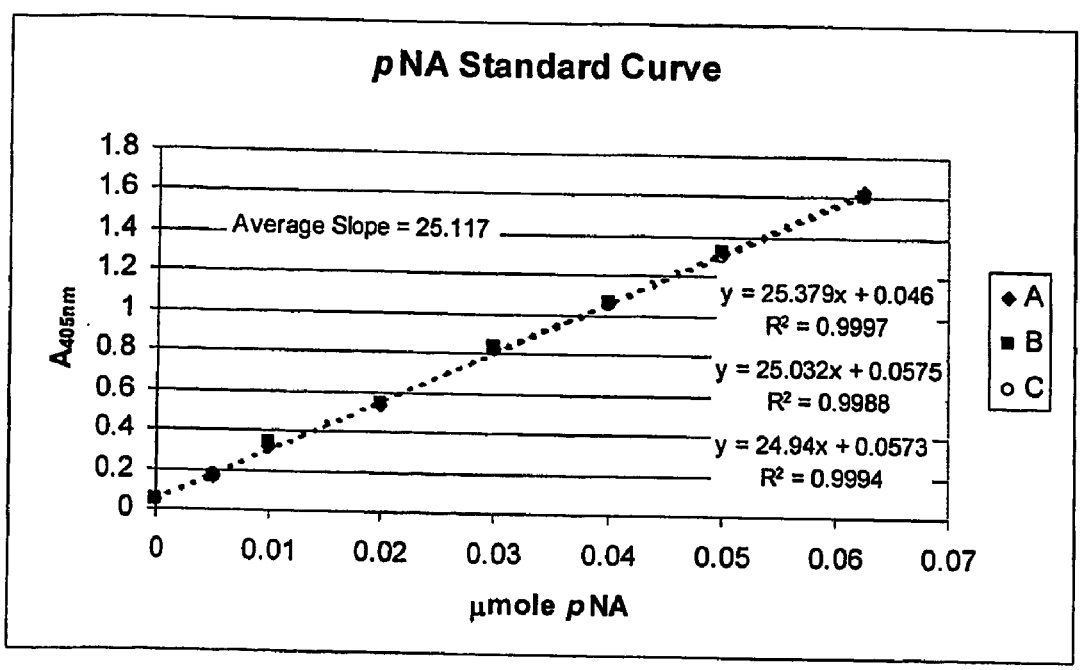
FIG. 6 is an illustration of a standard curve of (pNA) (para-nitroanalide), generated to allow conversion of pNA absorbance (A405 nm) to moles of pNA, as described in detail in Example 1, below.

The following assay was developed to determine protease unit activity using pNA linked small peptide substrates. This assay allows for the direct comparison of enzymes of the invention to Subtilisin on a unit per unit basis. Free pNA was used to create a standard curve to allow conversion of pNA absorbance (A405 nm) to moles of pNA, allowing direct quantification of the amount of pNA released by a protease (FIG. 6).

Figure 7:
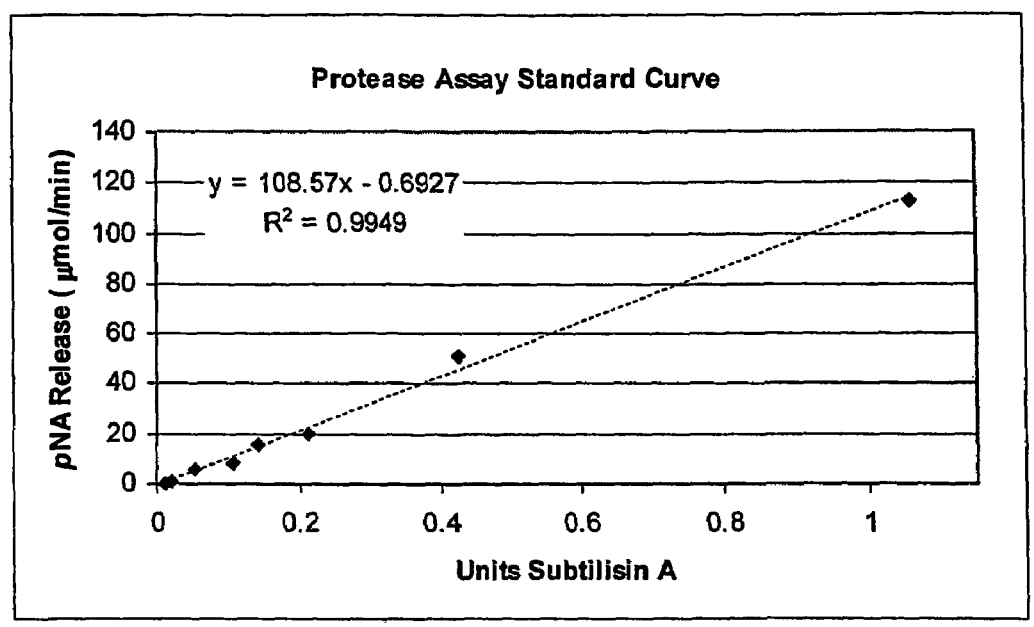
FIG. 7 is an illustration of a standard curve of subtilisin A protease, as described in detail in Example 1, below.

Subtilisin A activity (initial rate) on AAPF-pNA was measured over a 100 fold concentration range of enzyme (0.1 to 10 U/mL in assay, based on Sigma's supplied activity). The activity of Subtilisin A was linear with enzyme concentration over this range and allowed the determination of equivalent units of enzymes of the invention over a broad activity range. A Subtilisin A standard curve is shown in FIG. 7.

pH Assay

Figure 8:
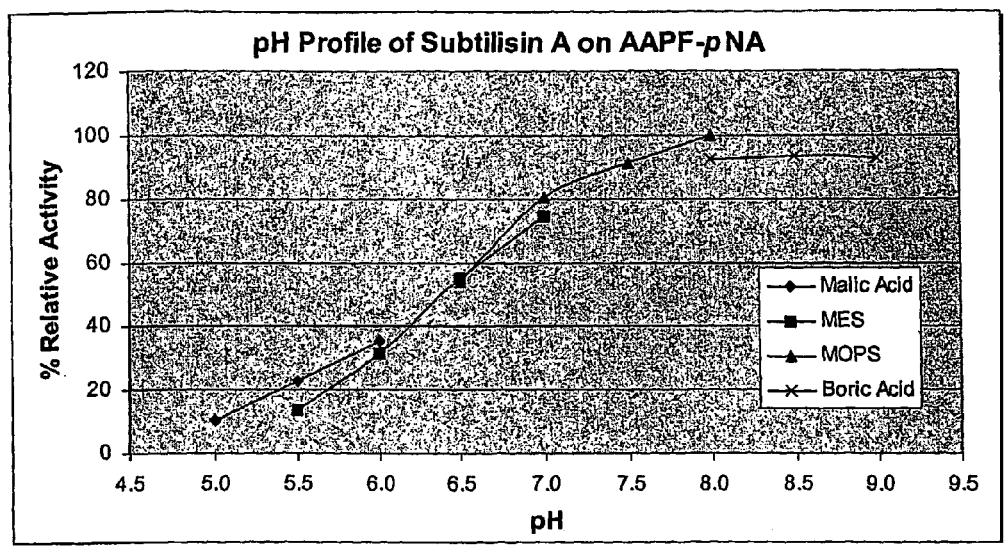
FIG. 8 is a an illustration of results if a protease activity using the small peptide substrate p-nitroanalide linked Alanine-Alanine-Proline-Phenylalanine, as described in detail in Example 1, below.

The following assay was developed using Subtilisin A to determine the relative activity of proteases at various pH's. Four different buffers were identified that would permit the testing of a range of different pH's. Protease activity was assayed using the small peptide substrate p-nitroanilide linked Alanine-Alanine-Proline-Phenylalanine (AAPF-pNA, Sigma, S-7388) as follows: The amount of Subtilisin A required to obtain an initial rate using the assay conditions was determined at the desired pH (5 mM AAPF-pNA, 37° C.). Reactions were performed in triplicate. Initial rates were determined and averaged. The percent activity at various pH's were determined relative to the sample with the highest activity, and percent relative activity was then plotted vs. pH. Substrate stability at the pH's tested was verified in the absence of activity. Results are illustrated in Table 6 and in FIG. 8.

[see next page for Table 6]

TABLE 6

| | Rates ($A_{405nm} \times 10^3$ min$^{-1}$) | | | | | | |
|---|---|---|---|---|---|---|---|
| pH Buffer | 1 | 2 | 3 | Ave. | Std Dev | % Deviation | % Relative Activity |
| 5.0 Malic Acid | 3.71 | 3.80 | 3.62 | 3.71 | 0.09 | 2.5 | 10.09 |
| 5.5 Malic Acid | 8.49 | 8.16 | 8.41 | 8.35 | 0.17 | 2.02 | 22.72 |
| 6.0 Malic Acid | 13.56 | 13.24 | 12.23 | 13.01 | 0.69 | 5.32 | 35.38 |
| 5.5 MES | 5.10 | 4.82 | 5.19 | 5.00 | 0.26 | 5.1 | 13.61 |
| 6.0 MES | 11.81 | 11.53 | 11.18 | 11.51 | 0.32 | 2.75 | 31.3 |
| 6.5 MES | 20.45 | 19.48 | 20.49 | 20.14 | 0.57 | 2.85 | 54.76 |
| 7.0 MES | 27.54 | 27.51 | 27.03 | 27.36 | 0.28 | 1.03 | 74.41 |
| 6.5 MOPS | 19.68 | 19.32 | 20.20 | 19.73 | 0.44 | 2.24 | 53.66 |
| 7.0 MOPS | 29.97 | 28.89 | 29.65 | 29.50 | 0.55 | 1.87 | 80.23 |
| 7.5 MOPS | 34.24 | 34.02 | 32.65 | 33.64 | 0.86 | 2.55 | 91.47 |
| 8.0 MOPS | 36.76 | 37.19 | 36.37 | 36.77 | 0.41 | 1.12 | 100 |
| 8.0 Boric Acid | 34.55 | 32.97 | 34.10 | 33.87 | 0.81 | 2.39 | 92.12 |
| 8.5 Boric Acid | 35.39 | 32.01 | 35.41 | 34.27 | 1.96 | 5.72 | 93.19 |
| 9.0 Boric Acid | 34.85 | 33.99 | 33.45 | 34.10 | 0.70 | 2.07 | 92.72 |

A number of embodiments of the invention have been described. Nevertheless, it will be understood that various modifications may be made without departing from the spirit and scope of the invention. Accordingly, other embodiments are within the scope of the following claims.

SEQUENCE LISTING (255 sequences)

SEQ ID NO: 1 - DNA, 1305 bp, Bacteria
atgtgttggtgggctcgcggtggggtaatggggcgcctcgtagctaacctcctagctctcaccctgctagcgctactgatcctgccgagtctcgccccggtggcgaccgctgtatcctacaagacgctcatagtgaagattgaccgtgcgaagttcgacccggagagggtgaagggcctaggcggtcgcgtggtgtacgtcgcccagcttgccccggttgccatcctggtggtgccggctcacgctgcggagcatgtcaagaagctgccgggcgtccttcacgtatccgaggatggcgaggtaaaggcgttcgcagttagagtctcgctaacccagccgccgcagacaatgccgtggggcgtggactacattgacgctgagcaggtgtggtcgataacgaagggcttcgtagacgtcaacggcgatggtgattccgagatcgaggttgccgtgatagactctggtgttgacctagaccacccagacctcgccgataacatcaagtggtgcgtagcggtgctcaacggcaggataagcaacagatgctccgatgtgaacggccatggtacgcacgtgaccggcacgatagccgcgcttgacaacgagataggcgttgtcggcgtcgcgccagaggtcgagatctacatgatcaaggccctcaagaactctgggagtggctcctggagcgacctcataatagccattgacctcgccgtgagaggcccagacggcgtgatagacgctgacggcgacggtgtgattgtcggtgaccctgaggacgacgcgccagaagtcataagcatgagcctcggtggttacgatccaccaccagagctccaggaggtcatagcggcagcctacagctacgggatcgtgatcgtcgcggcggcgggcaacgagggtctagacacgccagcctacccagcagcataccccgaggtcatagcggtgggcgccatcgatgagaacgccacggtgccagactggagcaaccgcaacccagaggtaacagccccaggcgtcgacatactcagcacataccccgacgacagctacgcggtgctaagcggcactagcatggccaccccacacgtgagcggcacagtcgcgctaatccaggcagccaggctcgcccagggcctaccactactaccaccaggcacagaggacgacctaaccacagacaccgtgagaggcatcctacacctaacagcggtcgacctcggagaccccggctacgacacgctatacggctacggcgtgatcaacgcctacgatgcggtgttaaccgcactaaacagctag

SEQ ID NO: 2 - protein, 434 aa, Bacteria
  SIGNAL (1)...(37)
MCWWARGGVMGRLVANLLALTLLALLILPSLAPVATAVSYKTLIVKIDRAKFDPERVKGLGGRVVYVAQLAPVAILVVPAHAAEHVKKLPGVLHVSEDGEVKAFAVRVSLTQPPQTMPWGVDYIDAEQVWSITKGFVDVNGDGDSEIEVAVIDSGVDLDHPDLADNIKWCVAVLNGRISNRCSDVNGHGTHVTGTIAALDNEIGVVGVAPEVEIYMIKALKNSGSGSWSDLIIAIDLAVRGPDGVIDADGDGVIVGDPEDDAPEVISMSLGGYDPPPELQEVIAAAYSYGIVIVAAAGNEGLDTPAYPAAYPEVIAVGAIDENATVPDWSNRNPEVTAPGVDILSTYPDDSYAVLSGTSMATPHVSGTVALIQAARLAQGLPLLPPGTEDDLTTDTVRGILHLTAVDLGDPGYDTLYGYGVINAYDAVLTALNS

SEQ ID NO: 3 - DNA, 1572 bp, Bacteria
atgtcagtgatgcgtggatcacggcgccgaaccgccaccgccgcggccgtcgccgtcgccgccctcaccctcggctccctctccaccctcccggccgccgccgcaccggccgccccggaaggcgtcatcgggaacgccggagccgaaggcacgatcgcgggcagctacatcgtcaccctcgacgagtcggcgcaggcggagaccgccaagggccgggccgtagcggccaagttcggcgcgaagatcaagcggacctacacctcggccgtcaacggctacgccgtcgaactctccgaggcccaggcgaagaagctcgcggccgaccccgccgtgacctccgtcgtccagaaccgcgtcttccacgtcgacggcacgcagccctccccgccctcctggggtctggaccggatcgaccagaaggcccttccgctgaaccagagctacacctaccccgacaccgcgggccagggcgtgacggcgtacatcatcgacaccggcgtacgcatcacccacagcgacttcggcggccgcgcctcctacggctacgacgccatcgacaacgacaacaccgcccaggacggccacggccacggcacccacgtcgccggcacggtcgcgggcacctcgtacggcgtcgccaagaaggcgaagatcgtcggcgtccgcgtcctcgacaactccggctccggcacgaccgagcaggtcgtcgcgggcatcgactgggtcacgcggaacgccgtgaagccggccgtcgccaacatgagcctcggcggtggcgtcgacaccgtcctcgacgcagccgtccgcaactcgatcgcctccggcgtcacgtacgcggtcgcggccggcaacgacagctccaacgcctccaactactcgccggcgcgcgtcaccgaggccatcaccgtcggctccacgaccaacaccgacgcccgctccagcttctccaactacggcacggtcctggacatcttcgccccgggctcctccatcacctcgtcctggaacaccagcgactccgccaccaacaccatctccggtacgtcgatggcgaccccgcacgtcgcgggcgccgcggccgtctacctcgccggcaacccgacggccaccccggcgcaggtctccacggccctcaccaccgccgccaccccgaacgtcgtcaccaacccgggctccggctccccgaaccggctgctctacgtcggcggcggcaccaccaccccgcccggcccgaagttcgagaacaccgccgactacgccatcgccgacaacgcgaccgtcgagtccccggtcaccgtcagcggcgtcagcggcaacgcccccgccgccctccaggtcccggtgaacatcgtccacacctacatcggtgacctccagatccagctgatcgcccccgacggctcggcgtacacgctgaaggccttcggcaccggcggcagctcggacaacatcaacaccacgtacagcgtgaacgcctcctcggaggtcgccaacggcacgtggaagctccgcgtcacggacaacgcgaacgccgacaccggcaagatcgactcctgggccctgcagttctga

SEQ ID NO: 4 - protein, 523 aa, Bacteria
  SIGNAL (1)...(36)
MSVMRGSRRRTATAAAVAVAALTLGSLSTLPAAAAPAAPEGVIGNAGAEGTIAGSYIVTLDESAQAETAKGRAVAAKFGAKIKRTYTSAVNGYAVELSEAQAKKLAADPAVTSVVQNRVFHVDGTQPSPPSWGLDRIDQKALPLNQSYTYPDTAGQGVTAYIIDTGVRITHSDFGGRASYGYDAIDNDNTAQDGHGHGTHVAGTVAGTSYGVAKKAKIVGVRVLDNSGSGTTEQVVAGIDWVTRNAVKPAVANMSLGGGVDTVLDAAVRNSIASGVTYAVAAGNDSSNASNYSPARVTEAITVGSTTNTDARSSFSNYGTVLDIFAPGSSITSSWNTSDSATNTISGTSMATPHVAGAAAVYLAGNPTATPAQVSTALTTAATPNVVTNPGSGSPNRLLYVGGGTTTPPGPKFENTADYAIADNATVESPVTVSGVSGNAPAALQVPVNIVHTYIGDLQIQLIAPDGSAYTLKAFGTGGSSDNINTTYSVNASSEVANGTWKLRVTDNANADTGKIDSWALQF

SEQ ID NO: 5 - DNA, 3684 bp, Bacteria
atgacgtcgaggaccacacccttcgacagggggagagccgcgctgatcgccgcgggcgtctccctcgtgatgctctcgacagggcagaccgccgccgccgggaccaccacatccgccgtaccggacaccttcaaggcgacggcgagcaccaccgtcaccctcgtcaccggcgaccgcgtcaccctcacggacctcggcggcggccggaagaccgtcaccgtcgaccgggccgagggcgccaccggcgcgatacgcagccggatcgacgacggccgggtcaccgtcgtccccgacgaggcccgcccctacctggactccggcgcgctcgacccgcggctcttcgacgtcaccggcctagtcgaacagggcgtcaccggcgagctcccgctcatcgtcacctacggcggcaagaccgccaggaccgccgccgcggccccccgcggcgccgagaccgtccgcccgctgcccagcatcggcggggccgccgtcaccgccaccgaccccgcctccttctggcgcggtttcaccgccgccccgaccgcccgggccgccgcccccgccaaggtctggctcgacgggcgggtcaaggccgcgatggccgagtccaacgcccagatcggcaccccgaaggcctgggaggcggggctcaccggcaagggcgtgaaggtcgcggtcctcgacaccggcgccgacctcgcccaccccgacctcgcgggccgggtcaccgagtccaagtcgttcatcgccggccaggaggtcgccgaccgcaacggccacggcacccacgtcgcctccaccgtcggcggcagcggtgccggctccgacggcaaggagaagggcgtcgcccccggcgccaccctcgccgtgggcaaggtcctcagcgacgagggcagcggctccgagtcggagatcatcgccggcatggagtgggccgccaaggacatcgacgcgaagatcgtctcgatgagcctcggctcccgtgaaccgagcgacggcaccgacccgatggccctggccgtcaacaccctcaccgccgagaccggcgccctcttcgtcatcgccgccggcaactccggctaccccggctccatcggctcgcccggcgccgccgactccgcgctcaccatcggcgccgtcgactccgccgacgaggccgcctacttcaccagccagggcccccgctacggcgaccaggccctcaagcccgacctgtcggcgcccggcgtggacatcctcgccgcccgctcccaactgctccccggcagcggcctctacacctccatgagcggtacgtcgatggcgaccccgcacgtcgccggtgtcgccgcgctgcttgccgagcggcaccccgactggaccggcgcccagctcaaggacgcgctgatgtcctcgtcgaagacgctcgacgcctcctcgtacgcgctcggctccggccgggtcgacgtggccgccgcgatcgccgcgaacgtcaccgcgaccggctccgccgacctcggcttcgtcgcctggccgtacgcgtcgagcaagccggtcacgaagaccgtcacctacaccaactcctccgacgcgccggtcgagctgaacctggccgtcgagggcatgccggccggcgtcgccgccctcgccgacaccaccctcaccgtccccgcccacgggaccgcgagcaccaccgtcaccggtgacggcacgaaggcccccgtcggccagtcctccggccggatcaccgccaccgccgccggcaccgtcgtcgcgcacaccgcgctcggcctggtcaaggaggaggagcgctacaccctcaccgtccacgtcaaggaccgcgacggcgcccccacccccgcccacctcggcgtgaagcagctcgccgaggacaccgaccccttcccggccgcggtcggcgactccggcaccctcgaactccgcctgcagcccggcacgtacaccgtcgacaccttcctcgacgtacgcggctcccacggcgaggactccctcggcctcggcttcctcaccgcgccggagatcaccctcgaccgtgaccgcgagatcaccctcgacggacggcagctgcgtgagatccgcgccgaggtcgaccggcgcaccgagacccgccagctcctgatggagttcgaccggaaggccaacggcgcctcctacggcggcgccgtccaggtcccgccgatgtacgactcgatcttcgcggcgcccaccgccaagcccgccaccggcaccttcgagtaccggacggtctggcgcctcggcaagccgatgctggagacgagcgtcgacggttcccgcctctccggggccaccccgcaggccggcgccaccctcctggagggccgccaccgcctcggcctcgtcgacgcgggcaccggaacacccgccgagtacaccggcaggaacgtcaccggcaaggccgtcctcgtccggctgacggagggcgccgacccggcgcaggtcgcccagaccgcccaggacgcgggcgccaaggccctgttcgtcaccgacgaccggcccggccgcctgatggaatggttcggcaccgccgactaccaggaccggccgctcgccgtcgccaccgtcaacgccgccgacgcccggcgcctcgccgccggcgccgcccgcggcaagcgcgtcgacctgaccggcacccgcttcacccccttcacgtacgacctctccgagggccaccccggcgccatcggcaaggacctggtcttccggcccgacgaggacgaactcgccaccgtccgctccaccttccacgcgcccaccaagcgcgccgaactgggcggcgagttccgctactcgatcaccgacaccttcccgatcggcttcggcttcaaggagtggatctccttcccggccgagcgcaccgagtacgtctccaccggcaccggccagcgctggcacgagtccgtcgacctcggcgagtcgctcgaggagcgcggcggccagtccgtgtaccggggcggcagccgggtggacctcgactggttcggtcccgtctggcacccctggctgggcaccggcctcggctggggccagcagcgcaccggcaacgacctgcgcttcaacacccccggctggggcgactccggcaacgaccacaccggcttcggcaacgtgtggagcgacgactcgatgacccagtacaccgaggtgtacgtcaacggcacccgcgtcgaccgcaagacgagctccggcgcctacgcctgggacgcgccggccgaagaggccgcgtacaaggtcgtcaccgacaccacgctcgacccggcgcgctggcggctcgcgaccaagggccacagcgagtggaccttccgctccgccgagaccccccacgacaagatcacctatctgccgatgctcaacctcggcttcgacgtggacaccgacatcaacggtgacgtccgcgccgggagcaggctgcccgtcgggatctccgccgagtacgtgaagggcgccaccggcaccggcagcatcggcaccggcaccctggaggtctcctacgacgagggcaggacctggacgaaggtcgccctcaagaaggcgcggcacggcgccgcctgggacggcgagctgcgcgtcccgtccggcgcggactccgtctcgctgcgggccggggcgagcgacgaccggggcggctcggtgacgcaggaactgatccgcgcggtgggcgtgaagtag

SEQ ID NO: 6 - protein, 1227 aa, Bacteria
  SIGNAL (1)...(32)
MTSRTTPFDRGRAALIAAGVSLVMLSTGQTAAAGTTTSAVPDTFKATASTTVTLVTGDRVTLTDLGGGRKTVTVDRAEGATGAIRSRIDDGRVTVVPDEARPYLDSGALDPRLFDVTGLVEQGVTGELPLIVTYGGKTARTAAAAPRGAETVRPLPSIGGAAVTATDPASFWRGFTAAPTARAAAPAKVWLDGRVKAAMAESNAQIGTPKAWEAGLTGKGVKVAVLDTGADLAHPDLAGRVTESKSFIAGQEVADRNGHGTHVASTVGGSGAGSDGKEKGVAPGATLAVGKVLSDEGSGSESEIIAGMEWAAKDIDAKIVSMSLGSREPSDGTDPMALAVNTLTAETGALFVIAAGNSGYPGSIGSPGAADSALTIGAVDSADEAAYFTSQGPRYGDQALKPDLSAPGVDILAARSQLLPGSGLYTSMSGTSMATPHVAGVAALLAERHPDWTGAQLKDALMSSSKTLDASSYALGSGRVDVAAAIAANVTATGSADLGFVAWPYASSKPVTKTVTYTNSSDAPVELNLAVEGMPAGVAALADTTLTVPAHGTASTTVTGDGTKAPVGQSSGRITATAAGTVVAHTALGLVKEEERYTLTVHVKDRDGAPTPAHLGVKQLAEDTDPFPAAVGDSGTLELRLQPGTYTVDTFLDVRGSHGEDSLGLGFLTAPEITLDRDREITLDGRQLREIRAEVDRRTETRQLLMEFDRKANGASYGGAVQVPPMYDSIFAAPTAKPATGTFEYRTVWRLGKPMLETSVDGSRLSGATPQAGATLLEGRHRLGLVDAGTGTPAEYTGRNVTGKAVLVRLTEGADPAQVAQTAQDAGAKALFVTDDRPGRLMEWFGTADYQDRPLAVATVNAADARRLAAGAARGKRVDLTGTRFTPFTYDLSEGHPGAIGKDLVFRPDEDELATVRSTFHAPTKRAELGGEFRYSITDTFPIGFGFKEWISFPAERTEYVSTGTGQRWHESVDLGESLEERGGQSVYRGGSRVDLDWFGPVWHPWLGTGLGWGQQRTGNDLRFNTPGWGDSGNDHTGFGNVWSDDSMTQYTEVYVNGTRVDRKTSSGAYAWDAPAEEAAYKVVTDTTLDPARWRLATKGHSEWTFRSAETPHDKITYLPMLNLGFDVDTDINGDVRAGSRLPVGISAEYVKGATGTGSIGTGTLEVSYDEGRTWTKVALKKARHGAAWDGELRVPSGADSVSLRAGASDDRGGSVTQELIRAVGVK

SEQ ID NO: 7 - DNA, 1332 bp, Bacteria
atgtttggattttcaatggtgaaaatggtgcgttctcactctcagaagttagataaaactttacgtgatcgaatactgaatctatataaaccattcaagtggacgccctgttttttacacaaaatgtttgaaagattttttaagaatagaaaaaaattatccgtcattatagaatttgagagtaattgctatcaagagggatgcttagaggtgaatcaagcttttacgaaacgcaatggttgtaaaattagaaacgagttctctatcatttcttgctgtagtgccgatataacaccatcagtcttagaagaggttttaactaattgtaaccatattaaaaaggtgtatttaaatcatgaagtgcgagctttattagatacggctgttatatcagcaaatgcaaaaaatattgtgagaaataacacgacactcacagggaaaggaatcactattgcggttattgataccggtatctttccgcacaccgacctttcaggaagaattattgattttgttgattttattaacgacagaacggaaacctacgatgataatgggcatggtacgcattgcgcaggagatgctctcggagatggttcagcttcttcaggactttatatggggcctgcaccagaagcgaatgtcattggtgtaaaggttttaaataaggtaggatctggttcattagaaacagtcatgcaaggggttgactggtgtataaaatataatgatcaaaatccggatcagaaaattaatatcattaatatgtctttaggagcgcctgcacagcgatatgagaatgagaacgatgatccgatggtgaaaatggtagagaaagcatgggagaatggaattgtcgtttgtgttgctgctggaaatgaggggccggaagcgagtacgattgctagtcctggggttagtgaacaagttataaccgttggagcgctagatgataaaacgacggctgatacaagatcagacgatgaggtcgctagcttttctagtagagggccaacgatatatgaaaaggtgaagcctgatattttagctccaggtgtagatattatatcattacgttccccaaattcttatttagacaaatttcaaaaagggaatcgagtggggtcagactatttttctttatcaggaacttccatggcaacacctatttgtgcagggatagcagcattaatattacaacataatccaaatgcaactccgcaagaggtaaaagacttattaaaaagaggaacggatttatggacaaatcgagatcctaatatttatggagctggttatataaatgcagagaattcagttcctgacaattaa

SEQ ID NO: 8 - protein, 443 aa, Bacteria
MFGFSMVKMVRSHSQKLDKTLRDRILNLYKPFKWTPCFLHKMFERFFKNRKKLSVIIEFESNCYQEGCLEVNQAFTKRNGCKIRNEFSIISCCSADITPSVLEEVLTNCNHIKKVYLNHEVRALLDTAVISANAKNIVRNNTTLTGKGITIAVIDTGIFPHTDLSGRIIDFVDFINDRTETYDDNGHGTHCAGDALGDGSASSGLYMGPAPEANVIGVKVLNKVGSGSLETVMQGVDWCIKYNDQNPDQKINIINMSLGAPAQRYENENDDPMVKMVEKAWENGIVVCVAAGNEGPEASTIASPGVSEQVITVGALDDKTTADTRSDDEVASFSSRGPTIYEKVKPDILAPGVDIISLRSPNSYLDKFQKGNRVGSDYFSLSGTSMATPICAGIAALILQHNPNATPQEVKDLLKRGTDLWTNRDPNIYGAGYINAENSVPDN

SEQ ID NO: 9 - DNA, 2181 bp, Unknown
  Obtained from an environmental sample
atgcgtgctatttggatgttcctggccgcaattaccaccccgctcgttgccgcgtccggcgcttttgcccccaccgcccttgcccaagagaaagagagcgacttgaccaccagccccgccctgcccgccgctccggtcgccgaacaacgcccgcacgacgtcaccctgcacggcaaaactctgtccgatccttatttctggctgcgcgatccgagctatccggtcgtcgatgacgcggacgtcctcgattatgtgaaggccgaaaatgcctatttcgacgcagcaatgaagccgcacgcaaagctcgtcgagacgttgtttcaggagatgaagggccgcatcaaggaggccgattcctcggtgccgcagaaggacggcgactggctctattggatcgaatatgacgagggcgccgaatataagaaatggtaccggaagccagcgtcaggctccggcgagacccagctcatcctcgacgaggtggcgatggccgagggcaaggattatttccgcctcgccgaactgtcgatcagtcccgacggccggctgatggcctattcgttcgacgacaacggttccgaacgcttcgaggcgcgcgtccgcaacctggaaaccggcgagctgctccccgacgtcattcccggcacgctgtcgtcgctcgtctggacgtcggggaacgacgcgatcctctatggcctcgcgaacgagaactggcgcaccgacaatgtccggctgcacaagctcggcaccccggtcggccaggacaaattgctctacaaggagcccgacatcggtttcggcgtcgggatcggcaagaccgcggccgacaattatatcgtcatcgggaccggcgataacgagacgaacgaggtctatctgctccccgcggacaatcccgaggcggagatgcaactcgtctcggcgcgccagaagggccgcgagtacagcgtcgacgagcgcgacggcacgctttacatcctcaccaacgacgagcatcccaatttccgcgtcgcgaccgcgagcatcgaggcgccggggacatggaaaacgctgatcccggggtcggatcacagctacatcaccggcttttcggtttttcgcgattatttcgtgctcgaagcgcgcgaggacgggctcgatcaggtcgatatccgcaaatatgacgcaccgctaacccccggccggatcgaattccccgaggccacttacgttgcggggctcggcgacaatcccgaatatcatcaggacaagctccggctcgattatgaatcgatggtcactcccgataccgtctatgattatgatatcgcgaccggcacgctcgaaacgctgaaggtacaggaaatcccatcgggttatgatgcaacgcaatatgtaaccgaacgggttaacctgccaagccgcgacggcaagacgatgatccccgcctcgctcgtctacaaaaagggcacgaagcgcgacggcagcgcgccgatgcatctctatgcctatggcagctatggctatcgcatcgcgccgggcttttcgacgacgcggctcagccttgtcgatcgcgggatgatctatgcgatcgcgcatgttcgcggcggcgacgacctcggccgcgcctggtatctcgcgggcaagaccgatcaccgcaagaatacgttcaacgatttcatcgacgtcgccaaggggttgatcgcgaagggctataccagcgccggcaagatttcgatcgagggccgctcggcgggcgggcaggtgatgggggcagtcactaacgaggcgcccgaattgtggggtgcggtgctggcgggggtgcctttcgtcgacgtgatcaacacgatggtcgacgaaacgctgccactcacccccggcgaatggccggaatggggcaatccgatcaccgacaaggcggcgttcgactatatgctgagctacagcccctacgacaatgtaacggccaaagcctacccgccgatgctggtgtcggcggggctcaacgacccgcgcgtaacctattgggagcccgccaaatgggtcgccaagctccgcgcgacgcgcaccaatgacgcgacgctgctgctgcgcaccaacatgggcgcgggccatgccggcaaatcgggccgctggggctcgctccacgaggatgccgaggagttcgccttcgtgctgacgcagcttggggtcgagaagtag

SEQ ID NO: 10 - protein, 726 aa, Unknown
  SIGNAL (1)...(28): Obtained from an environmental sample
MRAIWMFLAAITTPLVAASGAFAPTALAQEKESDLTTSPALPAAPVAEQRPHDVTLHGKTLSDPYFWLRDPSYPVVDDADVLDYVKAENAYFDAAMKPHAKLVETLFQEMKGRIKEADSSVPQKDGDWLYWIEYDEGAEYKKWYRKPASGSGETQLILDEVAMAEGKDYFRLAELSISPDGRLMAYSFDDNGSERFEARVRNLETGELLPDVIPGTLSSLVWTSGNDAILYGLANENWRTDNVRLHKLGTPVGQDKLLYKEPDIGFGVGIGKTAADNYIVIGTGDNETNEVYLLPADNPEAEMQLVSARQKGREYSVDERDGTLYILTNDEHPNFRVATASIEAPGTWKTLIPGSDHSYITGFSVFRDYFVLEAREDGLDQVDIRKYDAPLTPGRIEFPEATYVAGLGDNPEYHQDKLRLDYESMVTPDTVYDYDIATGTLETLKVQEIPSGYDATQYVTERVNLPSRDGKTMIPASLVYKKGTKRDGSAPMHLYAYGSYGYRIAPGFSTTRLSLVDRGMIYAIAHVRGGDDLGRAWYLAGKTDHRKNTFNDFIDVAKGLIAKGYTSAGKISIEGRSAGGQVMGAVTNEAPELWGAVLAGVPFVDVINTMVDETLPLTPGEWPEWGNPITDKAAFDYMLSYSPYDNVTAKAYPPMLVSAGLNDPRVTYWEPAKWVAKLRATRTNDATLLLRTNMGAGHAGKSGRWGSLHEDAEEFAFVLTQLGVEK

SEQ ID NO: 11 - DNA, 1374 bp, Unknown
  Obtained from an environmental sample
atgactccacaagaaacagtttcttttcccagatatacgaccagtgccgatattgcggcgggtgagcatccgtgtcccgtatgttcgcgtgaagcgcgtgacgaatttgtgccgttggttgctttgcccgaagatctacagcgattaattcgcgccaatgcgccggatactgccggatttgaagccgtttgtgcacgctgtgtcaggctttttgaacgcgccaaagataatattttgagtgatgcggcgatgaacaaagacggttcgtatgtgctttcgacacctttgcggctcgatgctgacgaacgttttacgggcaagggcgtgacgatcgcgtttctcgattcgggtttttatccgcacgtcgatctgactacaccgaacaatcgaattatcggttaccgcagcttgatgcatgcagaaggcgatctgacgacactttttcaatcggatgtagcgagctggcacggaatgatgacctcggtcgtcgcggcaggaaacggctcgctttccaacggtttttatcgcggaattgcgcccgatgccaatgttgtgttggtgaaactggcacgaacaggacgaatcaccgagcaaaatattcaagacggcttagaatggattttagccaatcgaacgaaatacggcattaaagtcgtcaatatttcggcaggcggcgattttgaacaaagttatctacacgatgcgctttcgcaaacggtcgaggaatgcgttgcgaaaggtttgacgatcgtttgcgcgatcggaaacgcgggacatttgccgactcatccggtttttccgcctgccagctcgccttcggcaattgcggtcggcggacttgatgatcataattccatcaaccgcgccaaacgcgggatgtatcgctcaagttatggtccgaccttggacggttttcaaaaacctgagatcatcgcgtcttcgatctgggttcccgcgccgatccttcccaacaccccaaccgctaagcaagttgattttctggagactttggacaaggcttcggatgaagatctgcatcggataatcgaagaaaatcgcgggatggacggtgagcttgaagccgcgcttgaccgtcccgcgtatatgcttcgccaaataattcttcttaaattacagcgcgaaagcgttattacccgtcattacaaatacgtggacgggacatcttttgccgcgccgatcgtttcatcagtaattgctcaaatgctcgaagcaaatccgaatctgacaccgcagaaaattaaacgaattttgatcagttcggcggaacgtcttccgcattatgaagtcgatcggcaaggctggggcgtgatcgatccgcgaaaagccgttgaaatggcactttcctttgtttaa

SEQ ID NO: 12 - protein, 457 aa, Unknown
  Obtained from an environmental sample
MTPQETVSFPRYTTSADIAAGEHPCPVCSREARDEFVPLVALPEDLQRLIRANAPDTAGFEAVCARCVRLFERAKDNILSDAAMNKDGSYVLSTPLRLDADERFTGKGVTIAFLDSGFYPHVDLTTPNNRIIGYRSLMHAEGDLTTLFQSDVASWHGMMTSVVAAGNGSLSNGFYRGIAPDANVVLVKLARTGRITEQNIQDGLEWILANRTKYGIKVVNISAGGDFEQSYLHDALSQTVEECVAKGLTIVCAIGNAGHLPTHPVFPPASSPSAIAVGGLDDHNSINRAKRGMYRSSYGPTLDGFQKPEIIASSIWVPAPILPNTPTAKQVDFLETLDKASDEDLHRIIEENRGMDGELEAALDRPAYMLRQIILLKLQRESVITRHYKYVDGTSFAAPIVSSVIAQMLEANPNLTPQKIKRILISSAERLPHYEVDRQGWGVIDPRKAVEMALSFV

SEQ ID NO: 13 - DNA, 783 bp, Bacteria
gtgagtcagaaccgaatggtccgtgcgctccagaagctggccgcggccggcgccgtcgtcctcgcggccgtcagcctccagcccaccaccgcctccgccgccccggcacccgtcgtcggcggcacccgcgccgcccagggcgagttcccgtggatggtccggctctccatgggctgcggcggctcgctgatctcgccgcaggtcgtcctcaccgccgcccactgcgtcagcggctccggcaacaacaccagcatcaccgccaccgccggtgtcgtcgacctgcagagcagcagcgccatcaaggtccggtccaccaaggtcctccaggcccccggctacaacggcaagggcaaggactgggcgctgatcaagctcgccagccccatcacctcgctgcccaacctgaagatcgccgagaccaccgcgtacaacagcggcaccttcacggtggccggctggggcgccgcccgtgagggcggcggccagcagcgctacctgctcaaggcgaacgtgccgttcgtctccgacgcctcctgccagagctcgtacggcagcgacctcgtccccgccgaggagatctgcgccggctacagccagggcggggtcgacacctgccagggtgactccggcggccccatgttccgcaaggacaacgccggagcgtgggtccaggtcggcatcgtgagctggggcgagggctgcgcccgcgccggctacccgggcgtctacacggaggtctcgaccttcgccgccgccatcaagtccgcggcggccaccctgtaa

SEQ ID NO: 14 - protein, 260 aa, Bacteria
  SIGNAL (1)...(33)
MSQNRMVRALQKLAAAGAVVLAAVSLQPTTASAAPAPVVGGTRAAQGEFPWMVRLSMGCGGSLISPQVVLTAAHCVSGSGNNTSITATAGVVDLQSSSAIKVRSTKVLQAPGYNGKGKDWALIKLASPITSLPNLKIAETTAYNSGTFTVAGWGAAREGGGQQRYLLKANVPFVSDASCQSSYGSDLVPAEEICAGYSQGGVDTCQGDSGGPMFRKDNAGAWVQVGIVSWGEGCARAGYPGVYTEVSTFAAAIKSAAATL

SEQ ID NO: 15 - DNA, 900 bp, Bacteria
atgcgcaccacccccacgagaaccgtccggctgctcgccgtcgcggcaggcctcgccgccgccgccgcgctcgccgcccccaccgcgagcgcgggcaccgccgactccgcgcggagcacccgcaccttcgacgccgccgccctctcggcgaccggcgacgccgtccgcgccgccgacgtggccggcaccgcctggtacgccgacacggccaccggcgagctggtcgtcaccgccgactccaccgtcacccccgccgggatcgcgaagatcaagcggcaggcgggggcgaacgcggacgccatccgggtcgagcggaccccgggcaagttcaccaagctgatctccggcggcgacgcgatctacgccaccagctggcgctgctcgctgggtttcaacgtccgggacagtgcgggcaactactacttcctgaccgccggccactgcaccgacggcgcgggcacctggtactccaactcctcccggaccaccgtcctcggcaccaccgcggggtccagcttccccggcaacgactacggtctggtgcgctacaccaactcctccgtcaccaagtccggcacggtcggcagcgtggacatcaccagcgccgccaacgccaccgtcggcatgtcggtcacccgccgcggctccaccaccggcatccacagcggctccgtgacgggcctgaacgccaccgtgaactacggcggcggtgacatcgtctccgggctgatccgtacgaacgtgtgcgccgagcccggcgactccggcggtccgctctactcgggcagccgggccgtcggcctcacctcgggcggcagcggcaactgctccacgggcggcacgaccttcttccagcccgtgaccgaggcgctgagcgcgtacggggtcagcgtcttctag

SEQ ID NO: 16 - protein, 299 aa, Bacteria
  SIGNAL (1)...(31)
MRTTPTRTVRLLAVAAGLAAAAALAAPTASAGTADSARSTRTFDAAALSATGDAVRAADVAGTAWYADTATGELVVTADSTVTPAGIAKIKRQAGANADAIRVERTPGKFTKLISGGDAIYATSWRCSLGFNVRDSAGNYYFLTAGHCTDGAGTWYSNSSRTTVLGTTAGSSFPGNDYGLVRYTNSSVTKSGTVGSVDITSAANATVGMSVTRRGSTTGIHSGSVTGLNATVNYGGGDIVSGLIRTNVCAEPGDSGGPLYSGSRAVGLTSGGSGNCSTGGTTFFQPVTEALSAYGVSVF

SEQ ID NO: 17 - DNA, 1137 bp, Bacteria
gtgaaacgcccggtgtccatcgtattccccgcgtatctcgagaagtacgcgcggctcctcgtagactacagcgtcgaggttaagcgcggcgaccgtgtcgttataaggacgtggcttgaggctctccccctcgcaaggctcgtctaccgcgaggtgctgaggaggggcgcgcaccccgcactatacctggaggatgatatcctcgccgagatattctaccgcgaggctagcgacgagcagatcgatttcgttgacgccctccgccgcagcatatacaccgagttcgacgtcgtgataaccctctttgccccgagccacttgaagaatcttgtgagtatcccgccggagaagcaggctaggaggagcaaggccctcgagccctacttcacgaggttcctccaggaggccgctgagggcaagaagaggtgggttctcgccgcctacccgacgctcgcgatggcccaggaggctggcatgacgcctatcgagttcgaggagttcgtggcaagagcagtgaaggtcacggaggacgacccggtcgccgcgtggaggaggcaagccgagtaccagaggaggatagtcgacgagatcctctcgaaggctgatgagcttgtcttcaagggcccgggcatcgacctaaccgtgaaggtcggtggccgccgctggatcgttgacgacggccacgagaatatgccgggtggcgaggtgttcacgggccccgtcgaggatagcgtggagggctgtgtacgcttcgacttcccgagcgtctatcgcggcgtggaggtagagggcgtcaagctgtgcttcaagaggggcgaggttgtagagtatgacgccgtcaagggccgcgacttcctcgctaagatgctgagtgtggacgagggcgccaagaggctaggagagctggccttcgggctgaactatggcataaccagggcgacgcgagagatactcttcgacgagaagatagggggtaccatccacatggcgcttggaaacggctacccggagaccggctcgagaaacaagagcgccatccactgggacctgataaaagacatgagggacccagaggcacgcgtctatgccgatggcgagcttatctacaaggctggcaggttcctactagaggagtga

SEQ ID NO: 18 - protein, 378 aa, Bacteria
MKRPVSIVFPAYLEKYARLLVDYSVEVKRGDRVVIRTWLEALPLARLVYREVLRRGAHPALYLEDDILAEIFYREASDEQIDFVDALRRSIYTEFDVVITLFAPSHLKNLVSIPPEKQARRSKALEPYFTRFLQEAAEGKKRWVLAAYPTLAMAQEAGMTPIEFEEFVARAVKVTEDDPVAAWRRQAEYQRRIVDEILSKADELVFKGPGIDLTVKVGGRRWIVDDGHENMPGGEVFTGPVEDSVEGCVRFDFPSVYRGVEVEGVKLCFKRGEVVEYDAVKGRDFLAKMLSVDEGAKRLGELAFGLNYGITRATREILFDEKIGGTIHMALGNGYPETGSRNKSAIHWDLIKDMRDPEARVYADGELIYKAGRFLLEE

SEQ ID NO: 19 - DNA, 2298 bp, Unknown
  Obtained from an environmental sample.
gtgaaacttaaaccctttccgctccgactccaggccaagacctggttgttattcatactgactctctgctacagccttgcggcttacccttcatctcaaaacacagaagccttggcgcaaattcaagataagattgctcaaaatgacagcactctagtcttggtagaattacttctaccgagcactgcggccaatttgagcggcggcaatctggcatctcacactgaacagctcagaaatattcagttgagtgtattgggtgacctaactaccggagccagcaccaactcaaacctgatcaatgccactttatttgattacgtcaatggtatggctctgacagttgatgcaaacctgctggatcagctgttgcagcacccttctgtgggccgcatttcgccaaatgatgttagttatccaatgctaacggatagcatgcccttgattggcgctgatcccacaggcggcttttccggacacggcggtcaaggtcaagcggtagccattttggatacaggcgttgataaatatcaccccgcttttcaaggtagagttatctcagaagcctgttattctgcgtctgcttatactgatgactggttgattcagtccttttcactatgccctggaggggttgctgaatcagtattgccaggctctggcatacactgcgagaaccaccgtgattgcggccacggtacacacgtagcgggcatagcaactggtcaagcggtaagcgtcaataatcaatctgtctttggtgttgctccgtcggccgacataatcgccattcaggtattcacactcccaaccagaccacaggctggattgcaggcccacactttggatattcttaaagggttggagcgcgtcatagccttgcacgacgcaggcacccctatcgctgcggctaatatgagtttagggttctcattatttcaggactcatgcgatgatcaccaacctctgatgactcaagccattgagaacttgcgcagtcgtggcattgcaaccatagtcgccagcggtaactatgggtttagagaccgcataagctggccggcatgtatatccagcgctatcagtgttggcagcacaacgaaagatgatgaagtatccgattttagcaatcacacctctcttgtaaatttactagcgcctggcagtgaaattcttgcagccgtgccgggtaacgcttttgaggtttatagcggtacatctatggccgcaccccatgttgccggtgcctgggctgtgcttaaaggcgcttacccagagtcaagtgtggacgacattttaactgcgctagacgctacaggtattcccgtattggatacacggcatggcgccattgatcatgccatacctcgcatacaggttgaccaagcacttttggccctaggcacccccaattacgattcaacttatccaagcatgcacattcgcggcactttcaacgcctgggacaacgccagcatgagacttgtagatgactttacatgggaagcaaatcttgtactgcaacctagcaacggtgctgctcaccttttcaagtttgatgcatacggtgattggcttagaaattatgggtccagtgccgaagcaggagtagcttcactttacggcgctgatcttgaaacacagtgcaccggagaagtgacggtaaggttcaacgatgccaacctttcatactctgtagaaggtgagggctgtactgattccaactggcgccgcactgttattttcatctatggtcaaacccaagtagggcaagacatgtttattcgtggcggaatagaccacggttacgccagcagtgtattgggcattaattgcacgcaggaaaacatgctttgcgccatacctattcgtcatttgaataaccttaacagcacgacaaacccctggaaagtgaacgaccaccacctggattggtatggtgctgagcctgggcaaagtagtagcgcggcaggcacaccatttgattggaccacaaacctctggccatccagctggggcaccagaagaacggttgaagttgatggttacggcgaaacacctctcaatcaatggggggatcattactggatgctggacgttgaaatggattgctccagaacggtgaatggctggtttgaagtaaaatcctttataacaaatgggcccggctgggaaagcgatgtgaatcaacccggacgcccttgggtatctggcaatcactttgctcaatgtggaacgcttaatgtctttaggcgcaatgaagatcaacccgtattggttggtcagccaattccgtga

SEQ ID NO: 20 - protein, 765 aa, Unknown
  Obtained from an environmental sample.
  SIGNAL (1)...(39)
MKLKPFPLRLQAKTWLLFILTLCYSLAAYPSSQNTEALAQIQDKIAQNDSTLVLVELLLPSTAANLSGGNLASHTEQLRNIQLSVLGDLTTGASTNSNLINATLFDYVNGMALTVDANLLDQLLQHPSVGRISPNDVSYPMLTDSMPLIGADPTGGFSGHGGQGQAVAILDTGVDKYHPAFQGRVISEACYSASAYTDDWLIQSFSLCPGGVAESVLPGSGIHCENHRDCGHGTHVAGIATGQAVSVNNQSVFGVAPSADIIAIQVFTLPTRPQAGLQAHTLDILKGLERVIALHDAGTPIAAANMSLGFSLFQDSCDDHQPLMTQAIENLRSRGIATIVASGNYGFRDRISWPACISSAISVGSTTKDDEVSDFSNHTSLVNLLAPGSEILAAVPGNAFEVYSGTSMAAPHVAGAWAVLKGAYPESSVDDILTALDATGIPVLDTRHGAIDHAIPRIQVDQALLALGTPNYDSTYPSMHIRGTFNAWDNASMRLVDDFTWEANLVLQPSNGAAHLFKFDAYGDWLRNYGSSAEAGVASLYGADLETQCTGEVTVRFNDANLSYSVEGEGCTDSNWRRTVIFIYGQTQVGQDMFIRGGIDHGYASSVLGINCTQENMLCAIPIRHLNNLNSTTNPWKVNDHHLDWYGAEPGQSSSAAGTPFDWTTNLWPSSWGTRRTVEVDGYGETPLNQWGDHYWMLDVEMDCSRTVNGWFEVKSFITNGPGWESDVNQPGRPWVSGNHFAQCGTLNVFRRNEDQPVLVGQPIP

SEQ ID NO: 21 - DNA, 867 bp, Unknown
  Obtained from an environmental sample.
atgaataacataaaaaagataataatgttactgttaacgatagcaaacggtttatatttaagttctcaaaatatagattttgacaaccaatccaaattaaacatacctcaattgcaacttcccaacgttcaaccggccataggaaccgaagaaaaggtttcgaaaatagtcggcggagtgacaacgacaaactcggaatttcctttcatagtttccttacaacattcttactacggccatttctgcggaggctcattaatagcaaaggattgggttttaaccgcggctcactgcgtagacggaataactccttcttacatagtaacgggcataagcaagctcacggataccgtcggtcaaagatttactccggttaaaataataaaacatccttcctggaattcccagacaatggactacgactacgctttaatcaaattaagcggacaatcctccgctccgattatagaattaaacacgctggaattaaacgccggaaccaatctaacggtagcggggtggggacttaccaaagaaaacggagacatctccaatacgcttcaaaaagtaactcttccgctcgtatccaaaacaacctgcttaaaagcttatcctaacgccataaccgacagaatgatatgcgcgggttacgccaccggcgggaaagactcatgtcagggagatagcggcggtcctttggtatacaaaacctcttcaaaagcgtatcttgtcggtgtggttagctggggtgagggatgcgcgagagaagggaaatatggaatttattcaaaggtaagcgccgttaaaaactggatagaaaacaccgtaaaaacgggaagttcaagctcacttatactcgattattga

SEQ ID NO: 22 - protein, 288 aa, Unknown
  Obtained from an environmental sample.
  SIGNAL (1)...(22)
MNNIKKIIMLLLTIANGLYLSSQNIDFDNQSKLNIPQLQLPNVQPAIGTEEKVSKIVGGVTTTNSEFPFIVSLQHSYYGHFCGGSLIAKDWVLTAAHCVDGITPSYIVTGISKLTDTVGQRFTPVKIIKHPSWNSQTMDYDYALIKLSGQSSAPIIELNTLELNAGTNLTVAGWGLTKENGDISNTLQKVTLPLVSKTTCLKAYPNAITDRMICAGYATGGKDSCQGDSGGPLVYKTSSKAYLVGVVSWGEGCAREGKYGIYSKVSAVKNWIENTVKTGSSSSLILDY

SEQ ID NO: 23 - DNA, 1647 bp, Unknown
  Obtained from an environmental sample.
atgaatcgttcgcaagtgaagttgctggccgcgtcgctgctgctggccctcagcctgccggccgcggcggaagacatctccggcaatacccggttcgacctcagttcggtgcaggaaggcgccacctatgaccgcttcatcgtggtctaccgcaatggcagcacggagcacgccagccccgccgccgcgatccaggcgctgtcggcggccgccggcaaggcgcagctttccgacgcgggaacgggcgcctcgcccaatacccttcgcgccggcggccgcgcgctgggcctgaactacaagcgcaagctcgccagcggcggcgacctggtcaccacctcgcgccgcctgagcgcgtccgaggcccgccagttcgtgcagcagatcgcggccgatccggccgtcgagttcgtgcagccggactacctgcgccacgcgctgggcaagccggtcaaggtgcagcccgagggcgcggccaccttcaccacgccgaatgaccagtactacgccggctatcagtgggattacctgcccgccgacggcgcagccttcaacgacaacagcctgggcaaggccgtggccaactggggcggcgccaacatccagaaggcatggagcctggccgacggcaccggcatcgtcatcgccagcctcgataccggcgtgaccaaccatccggacctggacctgaccctggccgacgccggctacgacttcatcagcaccgcgctggtgtcgggccgctccaccgacggccgcgcttcgggcggctgggatctgggcgactggaccaccggcagcaagtacctggccagcaacggcggctgcgtggactccacccatccggccgaggacagcagctggcacggcactcatgtgttcggcaccgccggcggcgagaagaccaacaacagcaccggcatggtcggtaccgccttcggcgccaaggtgctgccggtccgcgtgctgggccactgcggcggctacgacagcgacatcgccgacgccatcacctgggcttccggcggccacgtggacggcgtgccggacaacacccatccggcgcaggtgatcagcatgagcctgggcggcagcggcacctgcacctccagcacggtgaccggtcgcgccatcagtggcgcgatcagccgcggcgcgaccgtggtcgtggcggccggcaacagcaacgccaacgtgtccaacttctcgccggccagctgccccggcgtgatcgcggtcgcggccaccggcatcaccagccgccgcgcgtactactccaactacggcaagggcatcaccctggccgcgccgggcggcggcgtgtacgccaacgacggctccagcggttcgcaggcgaccaccggcttcatctggtcgaccatcgactcgggcaccaccacgccggccggttccacctacggcggcatggcgggtacctcgcaggccacgccgcacgtggccggcgcggtggcgctgatgcagagctaccgcctggcgctgggcaagtcgctgctgagctccgcgcaggtgacgtcgctgctgaagtccacggccaccgtgccgcacgtggccgccagcggcagcaagccgatcggcgcgggcatcctcaacgcctacgccgcggtgcaggccgcgggcgcgcagccctga

SEQ ID NO: 24 - protein, 548 aa, Unknown
  Obtained from an environmental sample.
  SIGNAL (1)...(23)
MNRSQVKLLAASLLLALSLPAAAEDISGNTRFDLSSVQEGATYDRFIVVYRNGSTEHASPAAAIQALSAAAGKAQLSDAGTGASPNTLRAGGRALGLNYKRKLASGGDLVTTSRRLSASEARQFVQQIAADPAVEFVQPDYLRHALGKPVKVQPEGAATFTTPNDQYYAGYQWDYLPADGAAFNDNSLGKAVANWGGANIQKAWSLADGTGIVIASLDTGVTNHPDLDLTLADAGYDFISTALVSGRSTDGRASGGWDLGDWTTGSKYLASNGGCVDSTHPAEDSSWHGTHVFGTAGGEKTNNSTGMVGTAFGAKVLPVRVLGHCGGYDSDIADAITWASGGHVDGVPDNTHPAQVISMSLGGSGTCTSSTVTGRAISGAISRGATVVVAAGNSNANVSNFSPASCPGVIAVAATGITSRRAYYSNYGKGITLAAPGGGVYANDGSSGSQATTGFIWSTIDSGTTTPAGSTYGGMAGTSQATPHVAGAVALMQSYRLALGKSLLSSAQVTSLLKSTATVPHVAASGSKPIGAGILNAYAAVQAAGAQP

SEQ ID NO: 25 - DNA, 1323 bp, Unknown
  Obtained from an environmental sample.
atgagcagcatcgcagtgtctccagcgccccagccgacaggcaatatgctggttatgttccatccggaccggaagcccagggatgtcgagcggctggtgtccaatgtcgtcggcgcgaaggtcgtgcattcgcgcgatttccgggccgatacgccgggcatcgccgaagccttcgcggatgccggtgcgctcaaccttgaccggctcggcatcgcggtcgtgaaggcgccggaggacgacggcttctcggtggccgccgagacgcttcgcaaccgcaaggaggtcgtcgaggtgcgtccggagttctggatgcacatgctggccgggtgggacgatcgctacgccgcctgggtgcgcgacggcctctccctgctggccgaccaggcgctgcgcggcgtcctgccgccgcctcccggcggcatcgcggcgggaccgggcgttgcggtcgcctcccagctctctgcgacctgggggcttgccgccaccggcgtcgatcgctcgtcctatacgggcgtcggcatcaaggtcgcggtgctggacaccgggttcgacttcacccatcccgacttcgccgggcgcagcgtcgtgtcaaaaagcttcgtgccgggcgaggacgtccaggatgtgcagggccacggcacccattgcatcggcacggcctgcgggccgctgtcgccggccgaacaggtccgctacggcgtcgcctacgaagccgagatctatgcgggcaaggttttgggcaacaacggctccggcgccgaacgctgggtgctcgccggcatggaatgggcgatcgagcagaagtgcgaggtcatatccatgtcgctcggccgcgccgtgcagccgggtgaggcgccggacgcattctatgagcgcgcgggcgaatacgcgctcgagaacggctcgctgatcatcgcggcggccggcaataacagctggcggcaatacaacgacatcaagccggtcggctcgccggccaatgccccctcgatcatggcggtggcggcggtcgacgccaagatgaaggtcgcgaacttctcctgcggcggcgtcaatccggcaggcggtgaggtcaacatcgccgggcctggcgtcgacgtgctgtcctccgtgccgatgccgcgcaaatatgaccgcttctccggcacctcgatggcgacgccgcatgtcgccggcatcgccgccctcctcgcccagtcggacaagagcctgcgcggcaaggcgctgtggacggcgctggaacaaggcgcgcgcaatatcgggcatcccgcgcgcgacgtgggcgcggggctcgtgatggcgccgggaagcgcctgtcgatag

SEQ ID NO: 26 - protein, 440 aa, Unknown
  Obtained from an environmental sample.
MSSIAVSPAPQPTGNMLVMFHPDRKPRDVERLVSNVVGAKVVHSRDFRADTPGIAEAFADAGALNLDRLGIAVVKAPEDDGFSVAAETLRNRKEVVEVRPEFWMHMLAGWDDRYAAWVRDGLSLLADQALRGVLPPPPGGIAAGPGVAVASQLSATWGLAATGVDRSSYTGVGIKVAVLDTGFDFTHPDFAGRSVVSKSFVPGEDVQDVQGHGTHCIGTACGPLSPAEQVRYGVAYEAEIYAGKVLGNNGSGAERWVLAGMEWAIEQKCEVISMSLGRAVQPGEAPDAFYERAGEYALENGSLIIAAAGNNSWRQYNDIKPVGSPANAPSIMAVAAVDAKMKVANFSCGGVNPAGGEVNIAGPGVDVLSSVPMPRKYDRFSGTSMATPHVAGIAALLAQSDKSLRGKALWTALEQGARNIGHPARDVGAGLVMAPGSACR

SEQ ID NO: 27 - DNA, 1893 bp, Unknown
  Obtained from an environmental sample.
gtgatcaagaagcagaaccttcgcatcaatgtgttggcagccgccgtgctgtcgctgaccggtgttggcctggcacaggccgccgacctgaaagcaaatgcgccgttgtccggcccgaagacgcagcaggtggatggcatcatcgtgaaataccgcgctggcagcgccgcagctgccgatgcgaacgccaagctggccgtggtcaactcggccatcgcccgcgccgtgccggcaggtaccaacgcggctgcgcgcagtgccgcgctgcgcccgcaggtggcccgcaagctgggcatcggtgccgatctgatccgcctgcagggagggatcgcgcgcgccgaactggacaaggtgctgggcgaactgaaggctgacccgaccgtcgaatatgcggtggccgacgccatcatgtatccgatcgatgctgcgtcgtcgccgcgtgcggacgccgtcgcgaagtccgatgcgtcgcccagcttcgtgcccaacgatccgtactaccagagccacaactggcacttccacaacccggtcggtggcgtgaacgcaccggccgcatgggacgtctcgcagggcgagggcatcgtggtggccgtgctcgataccggcatcctgcccgagcacccggatttcgccgccggcaccctgctggagggctacgacttcatcagccaggccagccgctcgcgtcgtgccgccgatggccgcgtgccgggtgcactcgactacggtgactggatgcccaccgccaatgcctgctacgacggttcgccggtacgtgacagcagctggcacggtacccatgtgaccggcaccatcgccgaggccaccaacaacggcctgcataccgccggcctggcctacaaggccaaggtgttgccggtgcgcgtgctcggctactgcggtggcaccctgtcggacatcaccgacgccatcacctgggcctcgggcggtgccgtggccggcatccctgccaaccagaatccggccgagatcatcaacatgagcctgggcggctccggcagctgcgatccggcctaccaggcggccatcaccggtgccaccaaccgcggtaccctggtggtggtggcagccggcaacgactcgatgaatgtggccaacgcccgcccggccaactgcgatggcgtggtctcggtcggcgcgaccggcatcaccggcgccatggcctactactccaacttcggtacccgcatcgatctgtccggcccgggcggtggcgtcaccgacggcaatccgaacggctatgtctggcaggcggtgtccagcagcaagacgtcgccgccggcagccggttccaccgagggttacacccttggcggcaaggccggcacgtcgatggcggcaccgcatgtggctgccgtcgccgcgctggtgcagagcgcgctgatcgccgccaaccgcgacccgctcgcgccggcgggcatgcgtaccctgctgaaggaaacggcacgtccgttcccggtcagcattccgtccgccaccccgatcggtaccggcatcgtcgatgccaaggccgcgctggacaaggccctggaagagccatgcaccgagaactgcgggccggtggccaagccgctgaccaacaaggtggccatcggcgggttgagtggtgccgccggcagcagcgtcctttacagcttcgaagccgcggcaggcaagcagctcagcgtcatcacctatggtggcaccggcaacgtgtcggtctacctggccaagggccgcgagccgagtgccaccgacaacgatgcgcgctcgacccgtccgggcacctcggaaacggtgcgggtgacggcaccgactgccggcacctactacatcaaggtggtgggcgaggcggcttacagcggtgtgagcattctcgccacgcagtaa

SEQ ID NO: 28 - protein, 630 aa, Unknown
  Obtained from an environmental sample.
  SIGNAL (1)...(27)
MIKKQNLRINVLAAAVLSLTGVGLAQAADLKANAPLSGPKTQQVDGIIVKYRAGSAAAADANAKLAVVNSAIARAVPAGTNAAARSAALRPQVARKLGIGADLIRLQGGIARAELDKVLGELKADPTVEYAVADAIMYPIDAASSPRADAVAKSDASPSFVPNDPYYQSHNWHFHNPVGGVNAPAAWDVSQGEGIVVAVLDTGILPEHPDFAAGTLLEGYDFISQASRSRRAADGRVPGALDYGDWMPTANACYDGSPVRDSSWHGTHVTGTIAEATNNGLHTAGLAYKAKVLPVRVLGYCGGTLSDITDAITWASGGAVAGIPANQNPAEIINMSLGGSGSCDPAYQAAITGATNRGTLVVVAAGNDSMNVANARPANCDGVVSVGATGITGAMAYYSNFGTRIDLSGPGGGVTDGNPNGYVWQAVSSSKTSPPAAGSTEGYTLGGKAGTSMAAPHVAAVAALVQSALIAANRDPLAPAGMRTLLKETARPFPVSIPSATPIGTGIVDAKAALDKALEEPCTENCGPVAKPLTNKVAIGGLSGAAGSSVLYSFEAAAGKQLSVITYGGTGNVSVYLAKGREPSATDNDARSTRPGTSETVRVTAPTAGTYYIKVVGEAAYSGVSILATQ

SEQ ID NO: 29 - DNA, 1506 bp, Unknown
  Obtained from an environmental sample.
atgcgtacgtcgcttcgggtttcccttgccagtgccatcaccctggtcctggccagcgcccccgccttcgcccaacccaccgaacgggtatggacgcgaggcatggccagcaacgagcagtacagcagtttcatcgtcaagtaccgggacggcagcagcaagcgcgtctccgccgacaccgcccaggacgcgctgaagaagcgcctcggcgcccagcagcgcagcaagcgttcgatcggcagtgcgccgccagcggccgcgtccgtgacccatcaacgccgcatgggcggcggcgccgacgtggtcaccacggacaagccactggaccgtccggaggccgagatcctgatgcagcgcatcgccgacgatccggacgtcgagtatgtgcagccgaactacatgatgagtgcattcgctacgccgaacgacccgcgctacggcgagcagtggcactacagcaatccgaccagtggcgcgcgcctgccaggcgcatgggatcgctctaccggccagggtgtggtggtggccgtggtcgattcgggctacctcaacaacaacgacctgcaggccaatctgttgccgggttacgacatgatctcgtcaacccgtccgttcagtgactggcagtgcatcatcgggggcatgaatcccggctgtggtggctccgacgatggtgacggacgcgacgccgatgcattcgatgcctcgggcattgcacacggcacccacgtcgccggaacggtcgctgcggtgaccaacaaccagatcggcgtggccggcgtggcctacaacgcaaaagtcgtaccggtgcgcgtactgggaaaccagggcaatggtggctccgccgatatcatcgacggcatgctctggagtgccggtatcaacgtgcccaacgtcccggccaatgccaacccggccgaggtcatcaatctgagcctgggtggccgccgcgcctgctcgccggccgagcaggatgcaatcgacgacatcacggcccagggcacgatcgtggtggtcgccgccggcaacagcaatcttgatgtgtccgagttcgccccggcgaactgcaagggcgtgatcgcggttgctgccaacgatcagggcggtcgtcgcgcgttctactccaactatggtgcaggcatccacatcaccgcaccgggtggcgagacctggtcgtgccgtgcgtcggtgggtgagttcctgccgctggccacgccgccgagccaggccaactgcgcacccacccgccagcatccggcgcagggcatcctgtccaccgtgggtaacaacgccttcgacttcatgtccggcacctcgatggcggcgccccacgtcgctggcatcgtcgcgctgatgcaggcggtggcgccggtgccgaagaccaccgaccaggtcaaggacatcctgcgtcgaaccgcgcacccgatcgcagcggcgaactgcccgggcggttgcggaccgggcattgtcgacgctgcagaagcggtgaaggccgccagcaactga

SEQ ID NO: 30 - protein, 501 aa, Unknown
  Obtained from an environmental sample.
  SIGNAL (1)...(24)
MRTSLRVSLASAITLVLASAPAFAQPTERVWTRGMASNEQYSSFIVKYRDGSSKRVSADTAQDALKKRLGAQQRSKRSIGSAPPAAASVTHQRRMGGGADVVTTDKPLDRPEAEILMQRIADDPDVEYVQPNYMMSAFATPNDPRYGEQWHYSNPTSGARLPGAWDRSTGQGVVVAVVDSGYLNNNDLQANLLPGYDMISSTRPFSDWQCIIGGMNPGCGGSDDGDGRDADAFDASGIAHGTHVAGTVAAVTNNQIGVAGVAYNAKVVPVRVLGNQGNGGSADIIDGMLWSAGINVPNVPANANPAEVINLSLGGRRACSPAEQDAIDDITAQGTIVVVAAGNSNLDVSEFAPANCKGVIAVAANDQGGRRAFYSNYGAGIHITAPGGETWSCRASVGEFLPLATPPSQANCAPTRQHPAQGILSTVGNNAFDFMSGTSMAAPHVAGIVALMQAVAPVPKTTDQVKDILRRTAHPIAAANCPGGCGPGIVDAAEAVKAASN

SEQ ID NO: 31 - DNA, 1929 bp, Unknown
  Obtained from an environmental sample.
atgagcaagcgcaacatcctcccctgcaccctggccgtcgcggtcatcgccgccatcggcgcggctggcgccactgccgccaagaagccgaagttcgcgacggacacggctgcgctgtcggccagcctcggcgatcagcagatcttccgccgcttcgtcgtgcagtaccgcgacggcacgcgcgagaagaccgaccgcaatgccggcgtcgccacgttcagccgcgcgttgtcgcgctcgggcctgtcgaagagccgcgcggccgacgccaagcacgtgcgtacgctcgccaacggccaccagctgctcaagctctcgcgcggcctcgatcgcgccgaagccgaggccctgctgcgccagctcaaggccgacccgaacgtggtctcggtgcgccccgatcgcctgcgccagatcgcgcgcctgcccaacgtgcagccggcctacgtgcccaacgatccgctgttccaggaataccagtggcacatgcgtgcgccggacggcggcgcgaccttcgacggcggccccaaccgcggcggcatcaacgcgccggcggcctgggacctcgccgacggcaacggcatcaccatcgccgtgctcgacaccggcatcagcgcgcatcctgacgtcgatacctcgatggccgatgccggctacgacttcatcagcgacgccttcgtctccggccgcgacaccgacgaccgcgtgccgggcggctgggacctgggcgactggaccatcggctatccgggcgcggaaacctgcatccagcgctacagctcctggcacggcacccacgtcgccggcaccgccggcgcgcagctgacggacaacggcgtaggcctgaccggcgtcgcctacaacgccaacgtcgtgccgatccgcgtgctcggccactgcggcggctacgacaccgacatcgccgacgcgatcgtctgggcggccggcggcgaggtggaaggcatgccgctcaacgagaacccggcgcacgtgatcaacctgagcctgggcggctcgggcgcctgcaccgactacgaggccgatgcgatcgcgcaggccaacgccctgggcgccgtggtcgtggtcgccgccggcaaccagaacgccaatacctcgggctattcgccgggcaactgcccgggcgtgatcacggtggcgtcgaacggcgtgaccagccgccgcgcctactactccaactacggcgacggcatcgagatcgccgcgcccggcggcggcgtctacgccaacgacggcagcggcggcgcgcagatctacgacggcttcgtctggcaggcggtcaaccccagcgacaccgagccgatgccggccgacgagatcgcgcccgacggctccaacggcggctacggcggatcggccggtacttcgcaggcggcgccgcacgtggccggcgtgatcgcgctgatgcagggcgcgcgcctggatgcgggcatgccgctgctcactccggaggaggtgctggacgtgctgcagtcgacggtgacgccgttcgcggtcgcgccctcgacctcgcagccgatcggcccgggcatcgtgaacgcggccgccgccgtggccaaggcgatcgagccgccgtgcgaggtcgactgcgcgccggatgccacgccgatcgtcaacggcgtcgcgctcaccggcctgaccggcaccgcgggcagcgaaacgctctacagcatcaccgtgccggagggcgcgcgcggtccgctcagcatcagcaccaccggcggcagcggcgacgtgaacctgctggtgagcttcgaggccgagcccaccgacgcggacgcggacttccgctcggcgcggccgggcaacaacgagacggtgcgcatcaacgcgccgcaggcaggcacctactacatcaagctggtcggcgcccgcgcctacagcaacgtgcgtctgctggtccgtcacaactga

SEQ ID NO: 32 - protein, 642 aa, Unknown
  Obtained from an environmental sample.
  SIGNAL (1)...(26)
MSKRNILPCTLAVAVIAAIGAAGATAAKKPKFATDTAALSASLGDQQIFRRFVVQYRDGTREKTDRNAGVATFSRALSRSGLSKSRAADAKHVRTLANGHQLLKLSRGLDRAEAEALLRQLKADPNVVSVRPDRLRQIARLPNVQPAYVPNDPLFQEYQWHMRAPDGGATFDGGPNRGGINAPAAWDLADGNGITIAVLDTGISAHPDVDTSMADAGYDFISDAFVSGRDTDDRVPGGWDLGDWTIGYPGAETCIQRYSSWHGTHVAGTAGAQLTDNGVGLTGVAYNANVVPIRVLGHCGGYDTDIADAIVWAAGGEVEGMPLNENPAHVINLSLGGSGACTDYEADAIAQANALGAVVVVAAGNQNANTSGYSPGNCPGVITVASNGVTSRRAYYSNYGDGIEIAAPGGGVYANDGSGGAQIYDGFVWQAVNPSDTEPMPADEIAPDGSNGGYGGSAGTSQAAPHVAGVIALMQGARLDAGMPLLTPEEVLDVLQSTVTPFAVAPSTSQPIGPGIVNAAAAVAKAIEPPCEVDCAPDATPIVNGVALTGLTGTAGSETLYSITVPEGARGPLSISTTGGSGDVNLLVSFEAEPTDADADFRSARPGNNETVRINAPQAGTYYIKLVGARAYSNVRLLVRHN

SEQ ID NO: 33 - DNA, 981 bp, Unknown
  Obtained from an environmental sample.
atgattccacccattggcggcaaatcggacccgatcgacacttccagcacctggcagtccagcctgtcgcaggctgccaacaccaaccagccgcagcagcaatacaatgcttccggtctgtttggtccctctggcggcccgcgccccgacgacatcgtccagggcccgatcggcgactgctacttcctcgcggcgctcgcctccttcgcgcagcagcagccccagctgatccgcaacgcgatcgccttcgatgccaacaccggaaacttcaacgtgacgctgcacaaggatgcgcaaccctggaatccgttcaatcgccacgagaaggtgaccgtccgggtcacgcagcaggaaatcgacagccatgtcatgaacgacaagggcgccaggctgggcaacgacggcgcgcggtggccggtggtcatggagatcgcgcgcgccaagatgctcgacagcaatccgaagaacggcttggacgaaggctacaatgcactcgagcatcagacgccgttcggcttgcttcagggcggcatgccgtcatcggccatggagaccatctccggccaacccggcgacacggcatacacgacgccgctcggcatcttcggagacgcgacgcaaggacccttgcagccgtggctctcgctcgtctcgcccgggcaggcgttagcgccggaggcggcaaaccatcactatagccaggtcaaagccgcgctggaggacggacggcccgtgacgctgggtaccggcttgtccagcccgcaggacggcctcgttcgcgggcacgcctatcaggtcgaggatatccagcgcaacgccgacggcagcgttaacgtcacggttcgcaatccatggggaaccaatcagggtgtcggcgaaggcaccaatccggccgacccgcgtgtcaccatcaggatgggagccgcgggcctgtcgctgttcgcaatcggttcaagcgcgcaggagaccagcgccggatag

SEQ ID NO: 34 - protein, 326 aa, Unknown
  Obtained from an environmental sample.
MIPPIGGKSDPIDTSSTWQSSLSQAANTNQPQQQYNASGLFGPSGGPRPDDIVQGPIGDCYFLAALASFAQQQPQLIRNAIAFDANTGNFNVTLHKDAQPWNPFNRHEKVTVRVTQQEIDSHVMNDKGARLGNDGARWPVVMEIARAKMLDSNPKNGLDEGYNALEHQTPFGLLQGGMPSSAMETISGQPGDTAYTTPLGIFGDATQGPLQPWLSLVSPGQALAPEAANHHYSQVKAALEDGRPVTLGTGLSSPQDGLVRGHAYQVEDIQRNADGSVNVTVRNPWGTNQGVGEGTNPADPRVTIRMGAAGLSLFAIGSSAQETSAG

SEQ ID NO: 35 - DNA, 1854 bp, Unknown
  Obtained from an environmental sample.
gtgatcaagaagcagaaccttcgcatcaatgtgcttgccgccgccgtgctgtcgatgaccgccgtcggtgccgtccacgccgccgggttgccgacccgtgaaccggtgcgccaggccagcaccgccgagccgggcacccagcgcatcatcgtcaagtaccgtgccggcaccgctgcggcgggcgaccggtcggccaagctgtccaccgtgcagtccgcgctgacccgcgccagcctgtccggtggcactacccgcgccagcgcgctcggcccgcaggtcgtgcgcaggctgggcgtcggtgccgacctgatccgcctgcaggggcgcctggcgcctgccgaactgcagcgcgtgctgaaggaactgaaggccgatccgtccgtgcagtacgccgaggccgatgtgaagctgcgccgtaccgagctgcgtgccggtgacgtgcagccggcgctggcgccgaatgatccctactaccagcagtaccagtggcacctgcacaacgccaccggcggcatcaacgcaccgtcggcgtgggatgtatcgcagggcgaaggcgtggtggtggcggtactcgacaccggcatcctgccgcagcacccggacctggtcggcaacctgctggaaggctacgacttcatcagcgatgccgagacgtcgcgccgtgccaccaacgaccgcgtgccgggcgcgcaggactatggtgactgggtcgagaacgacaacgagtgctacaccggctccgtcgccgaggacagctcctggcacggtacccatgtggccggtaccgtggccgagcagaccaacaacggcgtcggcatggccggtgtcgcgcacaaggccaaggtgctgccggtccgcgtgctcggcaagtgcggtggctacctttccgatatagccgacgccatcacctgggcctccggcggcacggtggccggcgtacccgccaatgccaacccggccgaagtcatcaacatgagcctcggcggcagcggcagctgcgacgggacctaccaggaagcgatcaatggcgcgatctcgcgtggcaccacggtggtcgtggcggccggcaacgagaccgacaacgcctccaaataccgtccagccagttgcgacggcgtggtgaccgtcggcgccacccgcattaccggcggcatcacctactactccaactacggcacccgcgtggacctgtccggtccgggtggtggtggcagcgtcgatggcaatcccggcggctacgtctggcagtccggttccgatgcggccaccacgccggagtcgggcagctacagctacatgggcatgggcggcacgtcgatggcctcgccgcacgtggctgccgtcgctgcactggtgcagagcgcgctgatcgccaagggcaaggatccgctggcccccgccgcgatgcgcaccctgctgaaggaaaccgcgcgtccgttcccggtcagcatcccgaccgccactccgatcggcaccggcatcgtcgatgccaaggcggcgctggccaaggcgctggaagagccgtgcaccgagaactgtggaccggtggcgacgccgctgaccaacaaggccgccgtgggggggctgaacggcacggccggcagcagccgcctgtacagcttcgaggcagccgctggcaagcagctcagcgtgatcacctacggtggcaccggcaacgtgtcggtctacatcgcccagggtcgcgagccgagcgccagcgacaacgatggcaagtcgacccgtcccggcacgtccgaaacggtacgggtgaacaagccggtggcaggcacctactacatcaaggtagtgggcgaagcggcctacaacggcgtgagcatcctcgccacgcagtaa

SEQ ID NO: 36 - protein, 617 aa, Unknown
  Obtained from an environmental sample.
  SIGNAL (1)...(27)
MIKKQNLRINVLAAAVLSMTAVGAVHAAGLPTREPVRQASTAEPGTQRIIVKYRAGTAAAGDRSAKLSTVQSALTRASLSGGTTRASALGPQVVRRLGVGADLIRLQGRLAPAELQRVLKELKADPSVQYAEADVKLRRTELRAGDVQPALAPNDPYYQQYQWHLHNATGGINAPSAWDVSQGEGVVVAVLDTGILPQHPDLVGNLLEGYDFISDAETSRRATNDRVPGAQDYGDWVENDNECYTGSVAEDSSWHGTHVAGTVAEQTNNGVGMAGVAHKAKVLPVRVLGKCGGYLSDIADAITWASGGTVAGVPANANPAEVINMSLGGSGSCDGTYQEAINGAISRGTTVVVAAGNETDNASKYRPASCDGVVTVGATRITGGITYYSNYGTRVDLSGPGGGGSVDGNPGGYVWQSGSDAATTPESGSYSYMGMGGTSMASPHVAAVAALVQSALIAKGKDPLAPAAMRTLLKETARPFPVSIPTATPIGTGIVDAKAALAKALEEPCTENCGPVATPLTNKAAVGGLNGTAGSSRLYSFEAAAGKQLSVITYGGTGNVSVYIAQGREPSASDNDGKSTRPGTSETVRVNKPVAGTYYIKVVGEAAYNGVSILATQ

SEQ ID NO: 37 - DNA, 3582 bp, Unknown
  Obtained from an environmental sample.
atgaccctgcactccctgtcccgcgcggcgtcccgccgtccttcgccgtccctgctggcctcggccatcaccggcaccctgcttgccgccatcgccgttccggcgctggccagccccaccaccgatgtcctgcagcgttaccagcagcagcgcgcagagcagtccgtcgcgttcgcgcgtgacctgcacagcgcttcgctggcggcgacctttgttgcgccgatcggcgccaacgaccagaccgtttccttcacgggcccgcgcaccagcgccgaggccgccggccccattctgggcaagccgggtgatgtggaaagctggcatagcgatgagttcaatgccgactggggtctggccgcgatgggggccgattacgcgtatgcgcgcggccttaccggtcagggcgtgcgcttgggcgtgttcgattcgggctctgcccttgcccacgacgaattcgccggacgcaacacctccagcatctccatcggcaacggcggctgcgccgacccgagcatcgtggcgggcgaaggcgcctgcggcagtacccgcggcgaccagcccgggtacaactactacggtctgggtcccggtgtgcctcccgcgcttgctgatcgactgatcgcggcgggccagccgtacggcttcagctacgccgaccatggcacgcacgtgttgggtaccgttggcgccaaccgcgatggcaccgggatgcatggcgtggcctttggcgccaacctgaccgctgcccgggtctttggcgacacgtattacgagtggcgcctggatcctgacaacttctaccggccgcgtgcgctgtatcgcactgacccggacgatgcagcaacactggacatgtatgcacaggccgaggcacagggcgtgcgcgtgctcaatcacagttggggtatctcgacccgccatgccacggtggccagtctggacgcgcagtacgcagcgatcggcgcggactatggtgtttacggcagcatttacggtgataccgagggtgcaccgggttccaagctgatccaggtgtggtcggcaggcaactcggccggggggatggccggcatcacggcggcattgccgcgctggaacccggagatcgagccgtactggctggccgtcgcgaatgtccgcctccccaccgcaggggaaacggactacgtcattgatgccagttccagcatctgcggtgcttcggccaactggtgcctgtccgcaccgggcaccaacatcgccagcacgatcgtggccggcgagatcaacggtcgcatggagctgaccgaggattacctgcgttttctcatcgaaagcgaaagtcctgaatacacctacggctacaagaccggcacatcgatggcggcaccgcacatcaccggtgcgctcggtctgctgatggagcgcttcccgtacctggacaacgcacaggtacgcgatgtgttgttgaccacggcacgcgacctgggcgcgcccggcgtcgacgcgatctacggctggggcatggtcgatctgaagaccgccatcgaaggctacggcctgctgcgcgtggacaccgacgtggtcatgaaccagaaggccggtggcctgaaggtgtgggaaggcgatgcgtgggacgactggaccaatgacatcggcggcccgggcaagctgaccaagtccggcatcggctggctgcgcctgagcggtgacaacagcttcaacggcgccatcgtgcgcgacggcgtgctggaactggacggtgccaatgcactgaccgcttcggtcgatgtgcagggcggccagttcctgctcaacggcagcctggtgtccaccacgctcaacagcctggggggcagcagcgtgatctccaccacgggcgtgctcgatggctcggcactcaacgtgaccggcggctcggtcaccttcaacggcctgcagcaggccggcgacaccacggtcggcagcggcggcagcttcgtgctcaatggccggctggtcgacagctcgctgacctcggcgggtgccacccgcgtcaatgccggggccttgctggacggctcggacctgttcgtcaccgccggcaccgtgtccttcaacggcgtgcagcaggatggcgcgacggtggtcggtgccaagggcaccttgaagggcgtcggcacgctgggcagcacccgcgtggaaggcatcatcgccccgggcaactcgatcggcacgctgaccgtcaacggcgattacgtgcagaccgccaccggcatctatcaggccgagctggcgccgggcagccgcagcgatctgctgcgcgtctccggtacggctacgctgggcggcacgctgaaggcgctgccggaagccggcgtgtactacctcggcgagcagttcaacttcctgcaggccgccggtggcatcaacggtcagttcgccacgaccgacttctcggccttctcgccgttcctgaagttcagcctgggctacagcgccaatgggctgcgcatcgacgtcgcccgcggcaacgcgctggccagcgctgcggtcacgccgaaccagatcgccgtggccaccagcgccgatggcctggccatcaaccaaggcctgcccaggccgctgacccagctgttcccggcccaggtcggtgcagcactggatgcgctgagtggtgaactccacgccgccacgccgatggcgctggtggaaagcagccgctacctgcgtgatgcggccctgagccgtgcggtcggcgtgcggtcgccgggtgccgcggatgaggctgccggtggtgcatgggtgcaggcgatcgggggcagcggcaagctcgatggcgatgccaacgctgcgcgcaccgattccaacagcaacgggctgctggtcggtgccgatcatgtgttcggtggtggctggcaggtcggtgggctggtcggtaccggccgtaccgacatcaagcaggccgcgggtcgcggcgcccggtcggagatcgacaacacccacttcggtgcctatgtgggcaaccagtggggggcatttggcctgcgcgccggtctgggctattcccgtcatgacgtggacagcaagcgtcagctgacgtttgccggctaccaggacgcactgtcggccaagtacgacgccaccacccgccagggcttcatcgagggcgcgtaccgcttcggtggtcgcgaggccgggctggagccgtacctgcagttcgcccgggtcgaggtggatgtggacggcatcaccgagcaggggggggctgcggcactgcacggccaggtcgccgacacccgcaccaacgtggcgaccgccggcgttcggttcgacaagggcctgaagacctcgtggcagcaggaaagctggctgcatgtccgcggtggcgtcggctaccgccgtgcctccggcgaccgcagccaggtcgccgatctggcctggaccggcggcaacagcttcgcggtcagcggtgcggcgattgccgacaacgccgtggtcgccgagctgggcctgtcggcctggttgagcccgcgcaaccagctggagctgggctacaacggcaccttcggtgacgacgcccgcgaccgcagcgtcaccgcgcgctggtccgtgcagttctga

SEQ ID NO: 38 - protein, 1193 aa, Unknown
  Obtained from an environmental sample.
  SIGNAL (1)...(37)
MTLHSLSRAASRRPSPSLLASAITGTLLAAIAVPALASPTTDVLQRYQQQRAEQSVAFARDLHSASLAATFVAPIGANDQTVSFTGPRTSAEAAGPILGKPGDVESWHSDEFNADWGLAAMGADYAYARGLTGQGVRLGVFDSGSALAHDEFAGRNTSSISIGNGGCADPSIVAGEGACGSTRGDQPGYNYYGLGPGVPPALADRLIAAGQPYGFSYADHGTHVLGTVGANRDGTGMHGVAFGANLTAARVFGDTYYEWRLDPDNFYRPRALYRTDPDDAATLDMYAQAEAQGVRVLNHSWGISTRHATVASLDAQYAAIGADYGVYGSIYGDTEGAPGSKLIQVWSAGNSAGGMAGITAALPRWNPEIEPYWLAVANVRLPTAGETDYVIDASSSICGASANWCLSAPGTNIASTIVAGEINGRMELTEDYLRFLIESESPEYTYGYKTGTSMAAPHITGALGLLMERFPYLDNAQVRDVLLTTARDLGAPGVDAIYGWGMVDLKTAIEGYGLLRVDTDVVMNQKAGGLKVWEGDAWDDWTNDIGGPGKLTKSGIGWLRLSGDNSFNGAIVRDGVLELDGANALTASVDVQGGQFLLNGSLVSTTLNSLGGSSVISTTGVLDGSALNVTGGSVTFNGLQQAGDTTVGSGGSFVLNGRLVDSSLTSAGATRVNAGALLDGSDLFVTAGTVSFNGVQQDGATVVGAKGTLKGVGTLGSTRVEGIIAPGNSIGTLTVNGDYVQTATGIYQAELAPGSRSDLLRVSGTATLGGTLKALPEAGVYYLGEQFNFLQAAGGINGQFATTDFSAFSPFLKFSLGYSANGLRIDVARGNALASAAVTPNQIAVATSADGLAINQGLPRPLTQLFPAQVGAALDALSGELHAATPMALVESSRYLRDAALSRAVGVRSPGAADEAAGGAWVQAIGGSGKLDGDANAARTDSNSNGLLVGADHVFGGGWQVGGLVGTGRTDIKQAAGRGARSEIDNTHFGAYVGNQWGAFGLRAGLGYSRHDVDSKRQLTFAGYQDALSAKYDATTRQGFIEGAYRFGGREAGLEPYLQFARVEVDVDGITEQGGAAALHGQVADTRTNVATAGVRFDKGLKTSWQQESWLHVRGGVGYRRASGDRSQVADLAWTGGNSFAVSGAAIADNAVVAELGLSAWLSPRNQLELGYNGTFGDDARDRSVTARWSVQF

SEQ ID NO: 39 - DNA, 1386 bp, Unknown
  Obtained from an environmental sample.
atgacgaaactcagcgtgctgctggagttccaacaggagttgccggaggcgttcgcctcgttcgaggccaccgcggcatccgatcacgaggcggcgcggcaggccgaatccctcgtcgcgaatctggcggggctggggatcgagctggatgaactgtcggtgccggtgccgatgttcgctcagggcaatgagggcgatcgcaccatcctgtcgcgattcgcggcgttcgccgcccccacccccaatccggaggagacggcccgcgcggtggtgctgccggtggaggtggaccgcgcccggctggaggagctggagcatcggcccggggtgacggtgtggccgaattccgaactgtccctgttcaacaccggcaacgaggacccgatcgatcttgcctggtccaagggcgggctggattgccggccgttccggccgggcgtttcgatcgcggtgatccggcggctgctcggggtggaaggcgtctggctggagggctatcgcggtcagaacatcatcgtcggcatcatcgacgagggcatcagcggcgagcactatccggtggtgggcggcttcagccggcccaacgcccgccgccccggcacggcgccgatcaccagccacggctcgatgtgcgccgccgacgtgctgatcgcggcaccggccgcccgcctgtatgactatccgttcctcggcgtgcccaactccgggggcgccttgcagatgtttcaggcggtgctggaccagcggcggctcgacggcaccccgcacctcaccaacaattcctatggcttcgtcggcgtgcccgatccgcggcagtggcccaaccacgaggtgcacaatatcaatcacccgctgcaccgcaaggtgcgggaggtggtggccgcgggcgtcgcctgctttttcgctgccggcaactgcggtgccgactgccccagcggcaactgccacccgagcggcatcggcgccggcaaatcgatccatgcctccaacagcctcgccgaggtggtgacggtcgccgccgtcaacagccggcacgagcggatcggctactcctcccaggggcccgggatgttcgagccgcgcaagcccgacctcgccagctattcccacatctttgccaacttcggcccgggccggccagccggaaccggcagccagccgttcgacaatggcacctcggcagcgacgccggtggcggccggggtggcggcgctgctgctgagcgctttcccggacgtggacccggaccggctcaagcgggtgctgacggcgaccgcgacgcgccttggcgaaacccgggacttcgatcatgattacggccacggcgtcatcaatgcggcggcggcctatcggtcgctccgccgggcatccggcgccatcagctga

SEQ ID NO: 40 - protein, 461 aa, Unknown
  Obtained from an environmental sample.
MTKLSVLLEFQQELPEAFASFEATAASDHEAARQAESLVANLAGLGIELDELSVPVPMFAQGNEGDRTILSRFAAFAAPTPNPEETARAVVLPVEVDRARLEELEHRPGVTVWPNSELSLFNTGNEDPIDLAWSKGGLDCRPFRPGVSIAVIRRLLGVEGVWLEGYRGQNIIVGIIDEGISGEHYPVVGGFSRPNARRPGTAPITSHGSMCAADVLIAAPAARLYDYPFLGVPNSGGALQMFQAVLDQRRLDGTPHLTNNSYGFVGVPDPRQWPNHEVHNINHPLHRKVREVVAAGVACFFAAGNCGADCPSGNCHPSGIGAGKSIHASNSLAEVVTVAAVNSRHERIGYSSQGPGMFEPRKPDLASYSHIFANFGPGRPAGTGSQPFDNGTSAATPVAAGVAALLLSAFPDVDPDRLKRVLTATATRLGETRDFDHDYGHGVINAAAAYRSLRRASGAIS

SEQ ID NO: 41 - DNA, 1281 bp, Unknown
  Obtained from an environmental sample.
atgtcctggaaaaccctttccaccagcctgactggagccgccgtactggcgctctcctcgttcgcggccagcgatgccgcagccaacaaccgcagcaatagcgaaacaagagcccagaccagcgcggatttccgccacgctgaacgacccgtcgaaggtcgctacatcgtggtcctcaaggacgaggttgcacgcctggcccatgagaacggctcagcccgcgccaacctgcccgaagtcgcccaggtggcacaggccatggcccgcggccatggggctcaactcgagcgcagctttacccatgccctgcgtggcttcgtggtcgaagccgacgaccgcgcgctggcccgactgctgctggacgaacgcgtcgccttcatcgaagaagacggcatcgtcagcatttcccagaccacccagccgaacgcaacctggggcctggaccggatcgaccagcgcgatcgcccccttgatggcaactacatctacgacacgaccgcgtcgaacgtgtacacctacatcgtcgacaccggtgtgcgcaccaaccacaacgacttcggtggccgcgtactgagtggatttaccagcatcaatgacggcaacggcaccaacgactgcaacgggcacggcacccatgtggccggcaccgtagccggcagcacctggggtgtggccaaggccgcccgcatcgtgccggttcgcgtgctgggctgccagggcaacggcaccaacgcgggcgtcattgccggcatggactggatcgccgccaaccacgtcaagcccgccgtggccaacatgagcctcggtggcggcgcctcgaccgcaacggacaacgccgtgaccaacatgcgcaatgccggcgtcaccgtggtcgtcgcagctggcaacgaaaaccagaatgcctgcaatgtttcaccggctcgctctggcaatgccatcaccgtgggttcaaccaccagcaccgatgcacgctcgaacttctccaactggggcaactgcgtggatatctttgctccgggcagcagcatccgttcggcctggcacaccagcaacaccgcagccaacaccatcagtggtacctcgatggccgctccgcacgttgctggcgtagccgccttgttcctggccaacaacccgaacgccaccccggcccaggttgaaaacgcgatctacagcaacggtagcaccggcaagctcagcggcctgaatggttcgcccaacctgctggtctactcgcgcttcggcggcggcggcggcccggatccagatcgaggcggatga

SEQ ID NO: 42 - protein, 426 aa, Unknown
  Obtained from an environmental sample.
  SIGNAL (1)...(22)
MSWKTLSTSLTGAAVLALSSFAASDAAANNRSNSETRAQTSADFRHAERPVEGRYIVVLKDEVARLAHENGSARANLPEVAQVAQAMARGHGAQLERSFTHALRGFVVEADDRALARLLLDERVAFIEEDGIVSISQTTQPNATWGLDRIDQRDRPLDGNYIYDTTASNVYTYIVDTGVRTNHNDFGGRVLSGFTSINDGNGTNDCNGHGTHVAGTVAGSTWGVAKAARIVPVRVLGCQGNGTNAGVIAGMDWIAANHVKPAVANMSLGGGASTATDNAVTNMRNAGVTVVVAAGNENQNACNVSPARSGNAITVGSTTSTDARSNFSNWGNCVDIFAPGSSIRSAWHTSNTAANTISGTSMAAPHVAGVAALFLANNPNATPAQVENAIYSNGSTGKLSGLNGSPNLLVYSRFGGGGGPDPDRGG

SEQ ID NO: 43 - DNA, 1881 bp, Unknown
  Obtained from an environmental sample.
atgaacaagacatccatcagcgtggccctggccgcggttctggccggcgcgctcggcgcgcaggtcgccgatgctgcccgtacccccgccaagatcgtgccgcgcatcgatgtggcgccgccggccgaggccgcgtccgaccgtatcgtcgtgcgctacgcgcaagcgcgcatcgccagcaccgatcgcaccggcaagctgcaggtcgcgaccgccgcgatccgccgcgccgggctcgagcgtccggtcgcctccggccgcgcggccaaggcgctgccggcgttgcaggtcggccatctgcgcacgaccgcggtcggcttcgacgtgctccggctgtcgcggccgctgcccgcgcgcgacttgcaggcgctggtgaccgaactggccgccgatccggcggtggcgtcggtgcacgtggatcggcgcatgcgcgcgaccggtgtggacaagcgcaccgtcacgccgcagttcacccccaacgacgagttcttcgccagccaccagtggcacctgcagggctcggccggcgcgatcaacgttgccaacgcctgggaccgctcgaccggtgccggcatcgtggtcgcggtgctcgacaccggcatcctggccgagcacccggacttcgccgacaacatcctgcccggctacgacttcatcaccgatcctttcgtgtcccggcgcgagaccgccgaccgtgtgcccggcgcactggaccacggcgactggaacccggtggcgggcgagtgctacagcggctcgccggtgatcgacagcacctggcatggcacccatgtggccggcacggtcgccgaggcgacccacaacggcatcggtggtgctggcgtcgcctacgacgcgcaggtgttgccggtgcgcgtgctcggccgctgcgggggctatgactctgacatcgccgatgcgatcgtctgggcctcgggcggcgcggtcgagggcgtgccggaaaacgtgcacccggctgaggtcatcaatctcagcctcggcggacaaggcacgtgcgaggcgatgacccaggcggcgatcgacagtgcggtcgcgcgcggcagcgtggtcgtggtcgcggccggcaactacaacgacgatgcccagcgctattcgccagccaactgcaagaacgtgatcacggtcggcgccaaccgcatcaacagcgggcgcgcgtactactccaacttcggtgcggtggtcgacgtttctggccccggcggtggcggcgagttcgacaccggcaatggcggctggaatggctacgtgctgcagaccggttacgacggcaagaccacgccgacctccgggcagtacctctacaccgggctgatgggcacctcgatggcggccccgcatgtgtcgggcatcgccgcgctggtgcagagcgcgctggtcgcccaggaccgtccgccgctgacgccggccgagatggagctcctgctcaagcgcaccgcgcgtccgttcaatgtgccgccgccggccaatacgccgatcggcgtgggcatcgttgatgcgacccgcgcgctggagaaggcgctggagaccccctgcgatccggccaccgagacctgcgagctcggcacccagctgttcaatggcgccgacgtcactggcctggcctccaacggcgagggcgcgctgttccgcttcgaggcccaggccggtcgcacgttgacgctgatgacgctggccggccgcggcgacgtcactctgcacgcgcgctatggcgcaccgccgacctcgaccgactacgagttccgctcggcgcgtgcgggcagcaacatcgagacgatccgcatcaccgcgcccaaggccggcacgtactacctgcagttgagcggcagctacacaggcctgactgtcgtcgcccgtcagtag

SEQ ID NO: 44 - protein, 626 aa, Unknown
  Obtained from an environmental sample.
  SIGNAL (1)...(25)
MNKTSISVALAAVLAGALGAQVADAARTPAKIVPRIDVAPPAEAASDRIVVRYAQARIASTDRTGKLQVATAAIRRAGLERPVASGRAAKALPALQVGHLRTTAVGFDVLRLSRPLPARDLQALVTELAADPAVASVHVDRRMRATGVDKRTVTPQFTPNDEFFASHQWHLQGSAGAINVANAWDRSTGAGIVVAVLDTGILAEHPDFADNILPGYDFITDPFVSRRETADRVPGALDHGDWNPVAGECYSGSPVIDSTWHGTHVAGTVAEATHNGIGGAGVAYDAQVLPVRVLGRCGGYDSDIADAIVWASGGAVEGVPENVHPAEVINLSLGGQGTCEAMTQAAIDSAVARGSVVVVAAGNYNDDAQRYSPANCKNVITVGANRINSGRAYYSNFGAVVDVSGPGGGGEFDTGNGGWNGYVLQTGYDGKTTPTSGQYLYTGLMGTSMAAPHVSGIAALVQSALVAQDRPPLTPAEMELLLKRTARPFNVPPPANTPIGVGIVDATRALEKALETPCDPATETCELGTQLFNGADVTGLASNGEGALFRFEAQAGRTLTLMTLAGRGDVTLHARYGAPPTSTDYEFRSARAGSNIETIRITAPKAGTYYLQLSGSYTGLTVVARQ

SEQ ID NO: 45 - DNA, 1875 bp, Unknown
  Obtained from an environmental sample.
atgcaacgtcgttcagtcctgaccgctgcggtcagcaccgccctcgtgtgcgcattcggtgccacgtcggtcctcgcttccgagctgcgcttcgccgagaacccgatcgagggccaatacatcgtcgtcctcaaggaggacgcggccacgctcgagggcgagacctcgatcgcgtccaaccgtcccaacgtggccaatgccgcgcgcaacctggcccgcgcccaccgcgccgaggtccgccacacctacaaccgcgccctgcgcggcttcgtggcccgcgccgacgagcgtgccctggcccgcctgctgcaggacccggccgtggcctacgtcgaggaggacggcatcgtctccatcggcgccacccagaccggcgccacctggggcatcgaccgcatcgaccagcgcgacctgccgctgaaccagacctacgtctacgacaccaccgcatccaacgtccacgtctacatcgtcgacaccggcatccgttcggcgcacaacgacttcggcggccgcgtcggttccggctacaccgccatcaacgacggccagggcaccaacgactgcaacggccacggcacccatgtcgcctccaccgccgccggtgccacctacggcgtggccaaggccgcccgcctctatccggtgcgcgtgctcggctgccagggcaacggctccaattccggcgtgatcgccggcatggactgggtcgccagcaaccacgtcaagccggccgtggccaacatgagcctgggcggcggcgcctcgcaggccaccgatgatgccgtgacgcgcatgcgcaacgccggcgtcaccgtcgtggtggccgcgggcaacgacaacgccaacgcctgcaactactcgccggcgcgtgcagcctcggcgatcaccgtgggctcgaccaccaacaccgacgcacgctccagcttctccaacttcggcacctgcgtgaacatcttcgcgccgggctccaacatcaccgccgcctggcacaccagcaacaccgcgaccaacaccatcagcggcacctcgatggcgtcgccgcacgtcgccggcgtggccgcgctgtggctggccaacaaccccaacgccaccccggcccaggtcgagcaggcgctgtacaacaacgccacgcccaacaaggtgaccaatgccggcaccggctcggccaaccgcctgctgtactcgcgctggggcggcggcaccaacccggatcccgatccggatccgacgccgggcagcctgaccaacggcgtgccggtcaccggcctctccggcgcagccggctccgagcgtcgctacaccatgaccgtcccggccggcgccaccaacctgtcgttcgccatcagcggcggcagcggtgatgccgacctgtacgtgcgcttcggttcggcgccgaccaccacgacctacgactgccgtccgtacctcaacggcaacaacgagacctgcaacatcagcaacgtgcaggccggcacgtaccacgtgctggtccgtggctacagccagtacagcggcgtgagcctggtgggcaacttcaccccggcctccggcggtggcgcgccctgcaccggctgcaccaagtacaccggctccctcagcggcaccggccaggcccaggtccagcccaacggcacctactaccagtccacccgctccggcacgcaccgcggctggctgcgtggcccgtccaacgccgacttcgacctggagctgtaccgctggaacggcagcagctgggcccgcgtggccagctcgaccggcggcaccagcaacgaggagatcagctacaacggcacggctggctactactactggcgcatcgtgtcctacagcggcagcggcagctacgacttctacctgacccgcccgtga

SEQ ID NO: 46 - protein, 624 aa, Unknown
  Obtained from an environmental sample.
  SIGNAL (1)...(26)
MQRRSVLTAAVSTALVCAFGATSVLASELRFAENPIEGQYIVVLKEDAATLEGETSIASNRPNVANAARNLARAHRAEVRHTYNRALRGFVARADERALARLLQDPAVAYVEEDGIVSIGATQTGATWGIDRIDQRDLPLNQTYVYDTTASNVHVYIVDTGIRSAHNDFGGRVGSGYTAINDGQGTNDCNGHGTHVASTAAGATYGVAKAARLYPVRVLGCQGNGSNSGVIAGMDWVASNHVKPAVANMSLGGGASQATDDAVTRMRNAGVTVVVAAGNDNANACNYSPARAASAITVGSTTNTDARSSFSNFGTCVNIFAPGSNITAAWHTSNTATNTISGTSMASPHVAGVAALWLANNPNATPAQVEQALYNNATPNKVTNAGTGSANRLLYSRWGGGTNPDPDPDPTPGSLTNGVPVTGLSGAAGSERRYTMTVPAGATNLSFAISGGSGDADLYVRFGSAPTTTTYDCRPYLNGNNETCNISNVQAGTYHVLVRGYSQYSGVSLVGNFTPASGGGAPCTGCTKYTGSLSGTGQAQVQPNGTYYQSTRSGTHRGWLRGPSNADFDLELYRWNGSSWARVASSTGGTSNEEISYNGTAGYYYWRIVSYSGSGSYDFYLTRP

SEQ ID NO: 47 - DNA, 1506 bp, Unknown
  Obtained from an environmental sample.
atgcgtacgtcgcttcgggtttcccttgccagtgccatcaccctggtcctggccagcgcccccgccttcgcccaacccaccgaacgggtatggacgcgaggcatggccagcaacgagcagtacagcagtttcatcgtcaagtaccgggacggcagcagcaagcgcgtctccgccgacaccgcccaggacgcgctgaagaagcgcctcggcgtccagcagcgcagcaagcgttcgatcggcagtgcgccgccggcggccgcgtccgtgacccatcaacgccgcatgggcggcggcgccgacgtggtcaccacggacaagccactggaccgtccggaggccgagatcctgatgcagcgcatcgccgacgatcctgacgtcgagtatgtgcagccgaactacatgatgagtgcattcgccacgccgaacgacccgcgctacggcgagcagtggcactacagcaactcgaccagtggcgcgcgcctgcccggcgcgtgggatcgctccaccggccagggcgtggtggttgcggtggtcgattcgggctatctcaacaacaacgacctgcaggcgaacctgctgccgggttacgacatgatctcgtcaacccgtccgttcagtgactggcagtgcatcatcgggggcatgaatcccggctgtggtggctccgacgatggtgacggacgcgacgccgatgcattcgatgcctcgggcattgcacacggcacccacgtcgccggaacggtcgctgcggtgaccaacaaccagattggcgtggccggcgtggcctacaacgcgaaagtcgtaccggtgcgcgtactgggaaaccagggcaatggtggctccgccgatatcatcgacggcatgctctggagtgccggtatcaacgtgcccaacgtcccggccaatgccaacccggccgaggtcatcaatctgagcctgggtggccgccgcgcctgctcgccggccgagcaggatgcaatcgacgacatcacggcccagggcacgatcgtggtggtcgccgccggcaacagcaatcttgatgtgtccgagttcgccccggcgaactgcaagggcgtgatcgcggttgctgccaacgatcagggcggtcgtcgcgcgttctactccaactatggtgcaggcatccacatcaccgcaccgggtggcgagacctggtcgtgccgtgcgtcggtgggtgagttcctgccgctggccacgccgccgagccaggccaactgcgcacccacccgccagcatccggcgcagggcatcctgtccaccgtgggtaacaacgccttcggcttcatgtccggcacctcgatggcggcgcctcacgtcgctggcatcgtcgcgctgatgcaggcggtggcgccggtgccgaagaccactgaccaggtcaaggacatcctgcgtcgaaccgcgcacccgatcgcagcggcgaactgcccgggcggttgcggaccgggcattgtcgacgctgcagaagcggtgaaggccgccagcaactga

SEQ ID NO: 48 - protein, 501 aa, Unknown
  Obtained from an environmental sample.
  SIGNAL (1)...(24)
MRTSLRVSLASAITLVLASAPAFAQPTERVWTRGMASNEQYSSFIVKYRDGSSKRVSADTAQDALKKRLGVQQRSKRSIGSAPPAAASVTHQRRMGGGADVVTTDKPLDRPEAEILMQRIADDPDVEYVQPNYMMSAFATPNDPRYGEQWHYSNSTSGARLPGAWDRSTGQGVVVAVVDSGYLNNNDLQANLLPGYDMISSTRPFSDWQCIIGGMNPGCGGSDDGDGRDADAFDASGIAHGTHVAGTVAAVTNNQIGVAGVAYNAKVVPVRVLGNQGNGGSADIIDGMLWSAGINVPNVPANANPAEVINLSLGGRRACSPAEQDAIDDITAQGTIVVVAAGNSNLDVSEFAPANCKGVIAVAANDQGGRRAFYSNYGAGIHITAPGGETWSCRASVGEFLPLATPPSQANCAPTRQHPAQGILSTVGNNAFGFMSGTSMAAPHVAGIVALMQAVAPVPKTTDQVKDILRRTAHPIAAANCPGGCGPGIVDAAEAVKAASN

SEQ ID NO: 49 - DNA, 1545 bp, Unknown
  Obtained from an environmental sample.
atgaaaaacatgatgaaaaaaatgacaactatactggcggttacatctgctggttgttttgcactaagcctgacatcggtagcggtagcagaaggtataaaaaaagcagagccggcagcagagcgtgaacttagcctggttgacctggcagaagataaaaccaaccgttacattattaaatttaaagagccggtcgcgcagatgagtgcaaccggcacagagcagcgcgctgagttctcggtacaacgtgcacagcaagtgctgcaaaaagccaacgttaacgcactgtcacatttaaaatcagtgcatgccagtgtagccgagctgactcctaaacagctgaagttactgcaggctaatcctgacgttgaatacattgaagaagatcataaacgttacctgatggatgtgatcacgcctatggcacaaaccacaccttatggtattaccatggtgcaggctaatcaggtaagtgatggcagtgctggcaatacaaaagtgtgcgttattgataccggttggacttcaggccatgaagatttacaaaactcgggcgtgacgggatattctttttccggccacggtaactggtatcaggacggtaacggccacggtactcatgttgccggtactatggtggcgctgaacaataacagcggtgtagtgggcgttattggttccggccaggccggggtgcacattgttaaaattttcaataattctggcaactggaccacagcttcaaatctgatcacggctattcagtcttgtaaagatgccggtgctaaagtagtcaatatgagtctgggtggcagctcgtctaaccagactgaaaatacggcgatgaccaatttctacaacggtggtatgttgctggtggctgcagcgggtaatgccggcaataccagtttctcctacccggcgtcatacaacgccgtggtgtcggttgctgcggtaaactcaagtggtgctttagccagcttttcacagcgtaactctcaggtagaaatttccggcccgggcgttaacgttaactctacctggaacaacggtggctacaacagcattagcggtacctctatggcatcgcctcatgttgcgggtgttgccgcgctggtgtggagtaatcacccgcaatgtactgcagcacaaattcgtaatgcacttaatgctacggctgaagatcgtggtgctgttggccgtgatacgtcttacggttggggtattgtcaaagccaaagctgcacatgattacttaaccaacaatggctgcggcggtggcggcagtaacccaccaccaacaggtggcgcaacattccctaacctgtcagcaaccagtggccagtggttaagaggcagttaccagatcccttcaggtgtatcaacggtaactttccagatatccggcggtagcggtgatgccgatctatatgttaactatggtactgaaccgagcacaacaacctataactgccggccttacctgaatggtaacaatgaagtttgtaccattaataatccgcaagccggtacctggcatgtgggg

SEQ ID NO: 50 - protein, 515 aa, Unknown
  Obtained from an environmental sample.
  SIGNAL (1)...(30)
MKNMMKKMTTILAVTSAGCFALSLTSVAVAEGIKKAEPAAERELSLVDLAEDKTNRYIIKFKEPVAQMSATGTEQRAEFSVQRAQQVLQKANVNALSHLKSVHASVAELTPKQLKLLQANPDVEYIEEDHKRYLMDVITPMAQTTPYGITMVQANQVSDGSAGNTKVCVIDTGWTSGHEDLQNSGVTGYSFSGHGNWYQDGNGHGTHVAGTMVALNNNSGVVGVIGSGQAGVHIVKIFNNSGNWTTASNLITAIQSCKDAGAKVVNMSLGGSSSNQTENTAMTNFYNGGMLLVAAAGNAGNTSFSYPASYNAVVSVAAVNSSGALASFSQRNSQVEISGPGVNVNSTWNNGGYNSISGTSMASPHVAGVAALVWSNHPQCTAAQIRNALNATAEDRGAVGRDTSYGWGIVKAKAAHDYLTNNGCGGGGSNPPPTGGATFPNLSATSGQWLRGSYQIPSGVSTVTFQISGGSGDADLYVNYGTEPSTTTYNCRPYLNGNNEVCTINNPQAGTWHVG

SEQ ID NO: 51 - DNA, 2874 bp, Unknown
  Obtained from an environmental sample.
atgaagtattcgaagttgagcctggccctggccgggctgatgggcgttggcgccatcgcggcagctgatgacgtcatggcaatgagttatcacgtgcaggacgatcgcgtcttcctcagcggcggcgtcaccgtcgccgatgtggtggcgctgcctgcactgctggccaaggcgcaggctgaaggccgtccgatccgcgaagtcgtgctgcgaacgtccaacggtggcgcgctgatcgccggcgagtggctgcaggcggtgatccgtacccagggcctggacaccatcgtgtccggccactgcatttcgtcctgctcgatcatgcagtccggtggcgtcaaccgttacctcggcggcgatctgccgctggtcgactcggtgcagatccatgccgccagcagtggtggcaggatcacctatgcgccgtcggcgcgcatgacccagatctacacaggcaactacggcggtggcatggatgcgggcctgttgcacaaggccatgtatgaagtggtgcagcccaatggcctgctggtattccgcgacccggcgcgtaccacgggtacgtcggttaccttcgatccggatggcagtgggagcaagctggagtcattcccgggccaggacatccgcagcaacagcatcatcaacacggcgggctatcgcgatccgggtgacacccttcgtgtcaccagcaacgtcagcggcgacatcaacccgggctacctgcgcaccgcgcgccagctgcaggccttcgtcgacgacgatttcgcgcgctggaataccgactgggccagcacctacatcaactatgcggtgagcctgtacaacttctccacgcggggggcgaacggtatcggcgcgcagtcgttgcagcagctgctcgccgaccccgacctccaggatgaactgcgcggccagctgcggctggccgatctggatgcctcgaccctggccaactccgccggcgtgatccgtgtcagcaatggcgccacctggcgcaccgctgaaaccaccggcgccgatttcattctggtggacaacggcaccatcgcactggagggtggtgcgctgcgcacccccgagctgcgggtgatgccgggcagcatcgtggttggccgcggtgatatcgcatcggtcggcaccgacagcgatgcgctgctggatggcaccggcccgtcctaccgcgaagatggcttcaaccgcctgcgcgtgttcggcacgctgatgccgcgcggtggggatctggtgacccacggctacgtcaacatcatgcccggcgggcaggtgctgttcgatgttaccgaaaccggtggtaccggcagtggccgcctgcgcgtcggcagcttctacgacggcggcgccgaggagggcgcgctggtgatcgcgcagggcgcacaccttgcgttgaatgtggcccagggcttctatgccggtgcctaccgccgcgatctggtggaagggccgatctaccaggggggcttccaggatgtcgtgcggctgggggacgccggatacagtgccagcatcactgctggtgaagtgttccgcccgcgccacaattcactgctcagcttcaacgtgaagcagacggccgatggcctgtggctgaccgccaacccgggcttcgaccagctgggcctgtttgccaacggtacgtccggcgacggcctgggccgcgcgctggcgaccgcctccgatcgccaggacaagggactgagatcgctgctgggcgcactgcagttcgccgaccgcgatgtgatcgcacaacaggccggtgccctgcgcggtgatgcgcacgccagcctgcgactggccgacaccgcgctggtgggcagcatcggcaacgtcgtgcagcagcaccagtcggccatgcgcagcggcggtgatgccgatggcctggcctcgcaggtggcgcagtcggtctcctcccagccgggcatgcgccatggcagcctgttcaaccagctggcgatgcacctggtcgagccggcgtcgggcagcgttgcgggcagcgctgatgctggacgcagccacggcatctgggcacgtggtttcgccagccatggtcgcatcgatgctgacggtggcgtggccggcctgagccacaccatcggtggcatcgtggtcggtgccgatacccgcgtggccgatgaccgcgtgaccctgggcgtcagcgtggccgcggcggacatgtcgaccaaggccagcgatggctctggtttcactggtgacgtgcgtgcgctggacgtgggcggctacctcgatgcgacgtacgcgcgcggctatctgtcggcggccgtgcgctacaccgatctgcgccacgatacgcgtcgcagcatcaacggcatcgatggcctgcagcagccactgcgcgccaagtacagcaacgatgcgatctccgcacgggtggaacatgcgttctccttcaccaccgccaagggcctggtgatccagccgttgctgccggtggtggactacgcgcgcacctcggccacccgcttcaacgaagggcagggcgccggtgcgctggttggccgcagcggcagcctggagagcatccgcgtgggtgcgggcctgcagctgttcaagaccttcgaaggcaacaacggcgagcgcatcaccccgcgcgcccgggtggtctggcagaaggaactgggcgattcgcaggcccgctacagcaccggcttcgccgcggctccggatctggtgttcggcgccagcagccaggcggtgggcgagcaggtgctggcctggaacctgggtgtgaccagccgtgccagcgagcggctgtccatcatggccgattatgtgggtgagcgccgcgacgggcagatccagaacggcgtgatgctgggcctgggctacaagttctaa

SEQ ID NO: 52 - protein, 957 aa, Unknown
  Obtained from an environmental sample.
  SIGNAL (1)...(27)
MKYSKLSLALAGLMGVGAIAAADDVMAMSYHVQDDRVFLSGGVTVADVVALPALLAKAQAEGRPIREVVLRTSNGGALIAGEWLQAVIRTQGLDTIVSGHCISSCSIMQSGGVNRYLGGDLPLVDSVQIHAASSGGRITYAPSARMTQIYTGNYGGGMDAGLLHKAMYEVVQPNGLLVFRDPARTTGTSVTFDPDGSGSKLESFPGQDIRSNSIINTAGYRDPGDTLRVTSNVSGDINPGYLRTARQLQAFVDDDFARWNTDWASTYINYAVSLYNFSTRGANGIGAQSLQQLLADPDLQDELRGQLRLADLDASTLANSAGVIRVSNGATWRTAETTGADFILVDNGTIALEGGALRTPELRVMPGSIVVGRGDIASVGTDSDALLDGTGPSYREDGFNRLRVFGTLMPRGGDLVTHGYVNIMPGGQVLFDVTETGGTGSGRLRVGSFYDGGAEEGALVIAQGAHLALNVAQGFYAGAYRRDLVEGPIYQGGFQDVVRLGDAGYSASITAGEVFRPRHNSLLSFNVKQTADGLWLTANPGFDQLGLFANGTSGDGLGRALATASDRQDKGLRSLLGALQFADRDVIAQQAGALRGDAHASLRLADTALVGSIGNVVQQHQSAMRSGGDADGLASQVAQSVSSQPGMRHGSLFNQLAMHLVEPASGSVAGSADAGRSHGIWARGFASHGRIDADGGVAGLSHTIGGIVVGADTRVADDRVTLGVSVAAADMSTKASDGSGFTGDVRALDVGGYLDATYARGYLSAAVRYTDLRHDTRRSINGIDGLQQPLRAKYSNDAISARVEHAFSFTTAKGLVIQPLLPVVDYARTSATRFNEGQGAGALVGRSGSLESIRVGAGLQLFKTFEGNNGERITPRARVVWQKELGDSQARYSTGFAAAPDLVFGASSQAVGEQVLAWNLGVTSRASERLSIMADYVGERRDGQIQNGVMLGLGYKF

SEQ ID NO: 53 - DNA, 2580 bp, Unknown
  Obtained from an environmental sample.
atgacacaacggatgatgcaaaggggagcaacgatgctcctcagcatcgcggtctgcgctgggctcgccctcaccgcaccgacgaccgcgttcgccagcacacctgccacagctcccacccacgacgactccgaagcggcgccgtcgtacatctcaggactcgtcgacccgcagagcgaagaggaggtgtctgctactccgccgatctcagccaataccgacgcgctgcacaccgtcgtcggcgaggcggatgccgagccggagcgtccctcgatgcagacccgcgcgaccgcgaagagtatcgcggctgtctgcaccgcagcagacttcgcgcaggcctcaggagaggccctggtcactttgatcaagggcagcacgaccgactgcgtcaacacgctgttctcggtcaagggctcgcaggcggcatccattttcaccgaggcgaagatggtcacggcggcgaatggccttcgtgccgtcgctcagtcctacaccggcgacaactccgggtcggccgcccagctcgtgctgttcctgcgggccgggtactacgtgcagtggtacgactcgagtgtccccgccttcggcaccgccctgcgcagcgccgtcagcgcagcgctggatgagttcttcaacagcccgcggtccaaagacgtcaccgacgccaacggcgagaccctgtctgaggcggtcacactgatcgactcggcagagctcaacgaccggtacatccacgtcgtcaagcgactgctcaccgactacaacgccggctacaactcatcgtggtggatgatgaacgcggtcaacggcacgttcaccgtgctgttccgaggtcaccaggtgcctgccttcgtgcagaaggtcgcctcggacacctcacttctcaccacgctccgggacttcgcactcggacacaccgacctgctcgccggggagaacgcctacctggtcacaaacgcgggccgcgaactcggacggttcctcggcgacgcgcccatcaaggctgcggtgaagccgatggtgaaggctgtgctcgaccagacctcgctcgacggacccacctcgggtctgtgggtggcgctcgcagagatggcggactggtacgacaagaccgactgcagctactacggcacctgcaacctgcaggagcgtatcgaagccaaggtgctgcccaccactcacgtgtgcagcccgagcatcacgatccgcgcccaggacatgaacgccgagcagctgaccgccagctgcgcgagcctgaacgctcaggacgcatacttccacgcggtcgccaaggaccctggccctgtgcccggagacgtgaacacgaagatcgaggttgtcgtgttcgactcgagcacggagtaccaggcctacgcgggcacgctgttcggcatcgacaccaacaatggcggcatgtacctcgagggtgacccgaccaagacgaacaacaaggcccgcttcatcgcctacgaggccgagtggctgcgccctgagttcgcgatctggaacctgaaccacgagtacacgcactacctcgacggtcgcttcaacatgcacggcgacttcaccgagaacatctcgactcccacgatctggtgggtcgagggcttcgccgagtacatctcgtaccactaccgtcagatgccgtatacggcggcgcagcagctggcagcaacagggcagtacaagctcagccagctgttcgacaccacgtacgaccacgacaccgatcgcatctaccggtggggctacctggcggtgagcttcatgctgaacaagcacccgatcgagatgcaggcggtgctgggcaactaccggtcaggaaactggaatgcagcccgcagctatctgaagaacagcatcggcaccacgtacgacgccgagttcaccgccttcctcgccgagtgcgcgcagggcaactgctctgctgacctcggcggcggcggtgagccgccccggaaccaggcgccgacggcggcgttcaccgtcgcgaccaacggtctcactgcgaccttcacggacgggtcgagcgacccggacggtcagatcgcgagccgcgcctgggacttcggcaacggcagaacgtcgaccgagaagaacccgtcggtgacctacgcgcaggccggatcattcaccgtcgccttgacagtgaaggatgacaagggcgcgaccgccacgacgacgcgcacggtcaccgtgaagatgcccgacaccggcaatcctgaccccggtggcgacacctggagcgtaccggtgtgcgccgacgcagacacccgcttgctcggtcaggcgtgtggacggatgggactgacggccaagaagggtgaatcccgctacctcatggtctgggtgcccgccggcactccccgcctgaccgtcacgtcgggtggcgggagcggtgacgccaacctgtacgtcagccactacggctggccgagcccgcagaaccacgtggcgcgctcgaccaactcgggcaacggcgaacaggtcgtggtcgagtggccggcatcgggctggaactacgtcgcgctgcacggagtcaaggacttcgcgaacgtgagcgcggtcgcccactactga

SEQ ID NO: 54 - protein, 859 aa, Unknown
  Obtained from an environmental sample.
  SIGNAL (1)...(32)
MTQRMMQRGATMLLSIAVCAGLALTAPTTAFASTPATAPTHDDSEAAPSYISGLVDPQSEEEVSATPPISANTDALHTVVGEADAEPERPSMQTRATAKSIAAVCTAADFAQASGEALVTLIKGSTTDCVNTLFSVKGSQAASIFTEAKMVTAANGLRAVAQSYTGDNSGSAAQLVLFLRAGYYVQWYDSSVPAFGTALRSAVSAALDEFFNSPRSKDVTDANGETLSEAVTLIDSAELNDRYIHVVKRLLTDYNAGYNSSWWMMNAVNGTFTVLFRGHQVPAFVQKVASDTSLLTTLRDFALGHTDLLAGENAYLVTNAGRELGRFLGDAPIKAAVKPMVKAVLDQTSLDGPTSGLWVALAEMADWYDKTDCSYYGTCNLQERIEAKVLPTTHVCSPSITIRAQDMNAEQLTASCASLNAQDAYFHAVAKDPGPVPGDVNTKIEVVVFDSSTEYQAYAGTLFGIDTNNGGMYLEGDPTKTNNKARFIAYEAEWLRPEFAIWNLNHEYTHYLDGRFNMHGDFTENISTPTIWWVEGFAEYISYHYRQMPYTAAQQLAATGQYKLSQLFDTTYDHDTDRIYRWGYLAVSFMLNKHPIEMQAVLGNYRSGNWNAARSYLKNSIGTTYDAEFTAFLAECAQGNCSADLGGGGEPPRNQAPTAAFTVATNGLTATFTDGSSDPDGQIASRAWDFGNGRTSTEKNPSVTYAQAGSFTVALTVKDDKGATATTTRTVTVKMPDTGNPDPGGDTWSVPVCADADTRLLGQACGRMGLTAKKGESRYLMVWVPAGTPRLTVTSGGGSGDANLYVSHYGWPSPQNHVARSTNSGNGEQVVVEWPASGWNYVALHGVKDFANVSAVAHY

SEQ ID NO: 55 - DNA, 2022 bp, Unknown
  Obtained from an environmental sample.
atgcgcaaatccaaccgcaccctgcggctgcagtcgcttgcggccgctacactgttcgcgttttccgccatcggtttcgcgggcgaggcgaacatccatctcgatgcgctcaccgagggcatcccgtacgaccgcttcatcgtcaagttccgcgatggcagccctgagcatgtgaatgccggcgcacgcgagcaggcgctggtcgcggccgctcgcggtcagggcctgcagctcggccatctgcgtcggctggccatcggtgccgacctggtcgaagtgtcgaccaagctgccggcaaaggcggccgaggccttgatgcgcgcgctggcacgcaatccgaacgtcgaatacgtcgagccggacgcgatcatgcgctcgctgctcacgccgaacgatacccgctaccccgaccagtggcattacttcgaggccaccggtggcgccaatcttcccgccgcttgggacaaggccaccggcagcggcgtggtcgtcgcggtgctcgacaccggcagcacgattcacagcgatctcgacgccaataccgtcgccggctacgacttcatcagcagctcgacgacggcgcgcgacggcaacggtcgcgatgccaaccctcgcgacgaaggcgattgggtcagcgccaacgagtgcggctacacccatccggcacagaactcgagctggcatggcacccacgtcgccggcaccatcggcgcggtcaccaacaacgccaagggcgtggccggcgtggccttcggcgccaaggtgcagcatgtgcgcgtgctcggccggtgtggcggtgcgttgtccgacatcgccgatgcgatcgtgtgggcctcgggtggcagtgtcagcggtgtgcccgccaatgccacgccggccgaggtgatcaacatgagcctggggggcagcggcagctgcggttcgacctatcaggccgcgatcgattcggcagtgaaccgcggcagcgtggtcgtggtcgctgccggcaacgacaacgtcaacgtgtccaacgcgcgtccggccaactgcaacaacgtgatcgcggtggcggccaccgatcgcaacggcgcacgtgccagtttctccaactacggcagcctgatcgacgtctcggcgccaggtgtgggtatctggtcgacgctcaattcgggtaccaccacgccgggcagcgagagctacgccgcctacaacggcacctcgatggcgacaccgcacgtggccggcatcgtggcgctgatgcaaagcgtatcggccaagaccccggcccaggtggagcagattctcaaggacacggcgcgtccgctgccgggtgcctgctccggcggttgcggggccggcatcgtcgacgcgctggcggcggtgaatgccgcgatcggcgggggcggcggcaacgtgctgcagaacggtgtcaccgtgaccggcctggctgccagcaccggcaacgcgctcaactacacgatggaggtgccggccggtgccaccaacctgcagttcgcgatcagcggtggcaccggcgatgctgatctctacgtcaagttcggcagcgcaccgaccgacagcagctacgactgccgtccctacaagtcgggcaatgccgagagctgcagcttcgccacgcccgccgccgggacctggcacgtgcgcgtgaaggcctattcgaccttttccggggtcagcctgaccggcagttacactccgccgagcagcgcgccgtgcagcgactgcaccaagtacagcggctcgctttccggcagcggcagcgcacagatccagcccgacggcagctactaccagtcgaccatctccggcacgcaccagggctggctcaagggtccggctggtaccgacttcgatctggagttgtaccgctggaacggcagcagctggagtcgggtcgcgcgtgccgcgaccagcggctcggaggaaacgctcagctacagcggcgcggccggctattactactggcggatcgtgtcctatacgggcagcggcagctacgacttctggctcaagcggccctga

SEQ ID NO: 56 - protein, 673 aa, Unknown
  Obtained from an environmental sample.
  SIGNAL (1)...(27)
MRKSNRTLRLQSLAAATLFAFSAIGFAGEANIHLDALTEGIPYDRFIVKFRDGSPEHVNAGAREQALVAAARGQGLQLGHLRRLAIGADLVEVSTKLPAKAAEALMRALARNPNVEYVEPDAIMRSLLTPNDTRYPDQWHYFEATGGANLPAAWDKATGSGVVVAVLDTGSTIHSDLDANTVAGYDFISSSTTARDGNGRDANPRDEGDWVSANECGYTHPAQNSSWHGTHVAGTIGAVTNNAKGVAGVAFGAKVQHVRVLGRCGGALSDIADAIVWASGGSVSGVPANATPAEVINMSLGGSGSCGSTYQAAIDSAVNRGSVVVVAAGNDNVNVSNARPANCNNVIAVAATDRNGARASFSNYGSLIDVSAPGVGIWSTLNSGTTTPGSESYAAYNGTSMATPHVAGIVALMQSVSAKTPAQVEQILKDTARPLPGACSGGCGAGIVDALAAVNAAIGGGGGNVLQNGVTVTGLAASTGNALNYTMEVPAGATNLQFAISGGTGDADLYVKFGSAPTDSSYDCRPYKSGNAESCSFATPAAGTWHVRVKAYSTFSGVSLTGSYTPPSSAPCSDCTKYSGSLSGSGSAQIQPDGSYYQSTISGTHQGWLKGPAGTDFDLELYRWNGSSWSRVARAATSGSEETLSYSGAAGYYYWRIVSYTGSGSYDFWLKRP

SEQ ID NO: 57 - DNA, 1293 bp, Unknown
  Obtained from an environmental sample.
gtggcaccggtgacgacgacctaccgtacggccgccctgctcgccgcgggcaccctcaccgccctcctcgcggcccccggccaggcctccgccgccggccccacgagcggcccggccggcgtgccccgccccgcgggacccgtcctggacggcagcggcgagtgcaccttcccgatgaagaagcagatcgagggcaccccctggccgctccagcgggtcctcctcgacgagctgtggcaggacaccaagggcaagggcgtccgggtcgcggtcatcgacacgggcgtcgacgacgtcaacccgcagctgaagcaggccgtcgacgccaaggcgggcaaggactacctcaagcccgacaagaagaacccgggcttcggcgacgagctgcgcggcaagaccgacggcaccgtcgacgaggtcggccacggcaccaaggtcgccgggatcatcgccgcccggccccgccccggcaccggcttcgtcggcctcgcgcccgaggcgacgatcatcccgatccggcagaacgacgagaagaacagcggcaagtcggacacgatggccgaggccatcaagtgggccgtcgccaagggcgcccacgtcatcaacatctcgcaggacaccacccagccgctggacgccgactcgccgatggccaaggcgatcgccctcgcgctgtccaagcagatcgtcgtggtcgcctccgccggcaacgacggcatggacggctccctgaagaagacctatccggccgcgttccccggcgtcctcgccgtcgcctcctccgaccggaacaacgagcgggccgcgttctcccagtccggcaccttcgtgggcgtcgccgcccccggcgtcgacgtcgtctccaccgtgcccggcggcggccagtgcgtcgacaacggcaccagcttctccgccccgtacgtcgccggcgtcgcggccctgctgcgcgccaagtacccggagtggaccgcggcgcagatcgtcacccggatcgagcagaccgccgtccgccccgtcaaggggcgggacaaccacgtgggctggggcgtggtcgacccggtgcgggcgctcgccgacacccccggcacgccgccctcctcgcccacgcccgacccgggcccgcccaagccgccggctcccgagccggcccgactggcgctgtcggagacgcctcaggagcgctccgaacggctcgccacctacacgttggggatcggtgtcgtcctggtggccgtggtcgccggaaccgccatcgtgatccgcgacagccgccgccggagggaggcccgttga

SEQ ID NO: 58 - protein, 430 aa, Unknown
  Obtained from an environmental sample.
  SIGNAL (1)...(31)
MAPVTTTYRTAALLAAGTLTALLAAPGQASAAGPTSGPAGVPRPAGPVLDGSGECTFPMKKQIEGTPWPLQRVLLDELWQDTKGKGVRVAVIDTGVDDVNPQLKQAVDAKAGKDYLKPDKKNPGFGDELRGKTDGTVDEVGHGTKVAGIIAARPRPGTGFVGLAPEATIIPIRQNDEKNSGKSDTMAEAIKWAVAKGAHVINISQDTTQPLDADSPMAKAIALALSKQIVVVASAGNDGMDGSLKKTYPAAFPGVLAVASSDRNNERAAFSQSGTFVGVAAPGVDVVSTVPGGGQCVDNGTSFSAPYVAGVAALLRAKYPEWTAAQIVTRIEQTAVRPVKGRDNHVGWGVVDPVRALADTPGTPPSSPTPDPGPPKPPAPEPARLALSETPQERSERLATYTLGIGVVLVAVVAGTAIVIRDSRRRREAR

SEQ ID NO: 59 - DNA, 1203 bp, Unknown
  Obtained from an environmental sample.
atgtcaaacaatagccgcaagcccgtcatcatcacgttcaagcgcaaggacaagcgccagagcaagcaggacaagcaggaggctgtccgctccgcgatatcctcgcgcctccgcttcctcaccaccgaggacatctcccgcgatgggcgggcggtggcctcgggcgagaacctcgaaatggtcggctacgacgtcaaccagtacgaggcgccgatcctgatggcccgcctcactaacgaggagatcgccgagctgaagaagaacaaggacgtcgcccgggtggaggacgacggcgagatgtacgcccttgagcttagccgcgaggggcagccgtcggtgctttcgcagaccattcccaccggcatctcccagatcaaggcgcccgaggcctggggctccagccaggggctcggcatccaggtctacatcctcgataccgggatccagtcggaccatcccgatctcgtccagaacctgaaagcgggcaagagcttcgtgaccaacgagagctcgaccgaggacttccacggccacggcacccactgcgccggcaccgtcgccgccgccttcaacaacttcggcgtcgtcggcgtcgccccgttcgcctatctctacccggtgaaggttctctcggcgaccggcagcggccagtggagctggctgatcgccggcctcgactgggtcgcctccaagaagggccatcgcatcgccagcatgagcctcggcggagggggcgcgccgcaggcgctcgccgacatgtgcgaggcggtctacaacaagggcgtcctgctcgtcgccgccgccggcaacaacggccctggcaacaacacggtcggcttcccggcgaagtacccccacgtcatggccgtgtcggcggtcgacagcaacgaccagatcgccagcttctcgagccgtgggccggaggtcgagatcgcggcgcccggcgtgcaggtgctctcgaccatccgcaactccggctacggccggatgagcggcacctcgatggcctgcccgcacgtcgccggcgccgccgcgctcgcctggggctcgcaccgcggccacaacaacaagcagatccgctggctgctcaacgtctttgcggacaaggtcggcgaccaggacccgcagcactacggcaacggccgcgtcaacgccaacaactcggcgttctttatcggcaacgccgccgagcaccagctctga

SEQ ID NO: 60 - protein, 400 aa, Unknown
  Obtained from an environmental sample.
MSNNSRKPVIITFKRKDKRQSKQDKQEAVRSAISSRLRFLTTEDISRDGRAVASGENLEMVGYDVNQYEAPILMARLTNEEIAELKKNKDVARVEDDGEMYALELSREGQPSVLSQTIPTGISQIKAPEAWGSSQGLGIQVYILDTGIQSDHPDLVQNLKAGKSFVTNESSTEDFHGHGTHCAGTVAAAFNNFGVVGVAPFAYLYPVKVLSATGSGQWSWLIAGLDWVASKKGHRIASMSLGGGGAPQALADMCEAVYNKGVLLVAAAGNNGPGNNTVGFPAKYPHVMAVSAVDSNDQIASFSSRGPEVEIAAPGVQVLSTIRNSGYGRMSGTSMACPHVAGAAALAWGSHRGHNNKQIRWLLNVFADKVGDQDPQHYGNGRVNANNSAFFIGNAAEHQL

SEQ ID NO: 61 - DNA, 1824 bp, Unknown
  Obtained from an environmental sample.
atgaagtcacggaaatcgatgtacccggcagtcttgaaactgtgcgcggcggccgtcctcggcctcggcgccagcgcagcgttcgccggcgtgccggccggcgcagccaccgcatccgccgcgcaaggcgcgggcatgctcgaccagaccgatcgcctgatcgtcaagtacaagggcgaatccgcaccgagcgccaagggcctgacccgcgccgccgcctacgtgccgatggccgcatcgcgcaaggccgtggtcgaccaggtcggccgcaagcacagcctgacggtccaggaactgcacgcgatcggtaccggcgcccgcgtgctcaagctgaaccgcaaggtctcggtggccgaggccgccaagctcgccgccgaactggcagccagcgatgcttcggtcgagtacgccgagccggaccgcatcatgaagccgatgttcacgccgaacgacacctactacaaccagcagtgggattatttcgacgccgtcggcggcatgaacatgccggcagcctgggacaaatcgaccggcaccggcatccgcgtggccgtgatcgacaccggctaccgcccgcacgtcgacctgcagggccagatcctggccggctatgacttcatcatcgataccgccatctcgaacgacggcaacggccgcgacagcgacgccagcgatccgggcgactggaccgtcgccggccagtgcggcaccggctcggcagcctcgaactcgagctggcacggcacccacgtggccggcaccatcgccgccctgaccaacaacggcatgggcgtggccggcgtcgcctacaacgccaaggtcgtgccggtgcgcgtgctgggccagtgcggcggctacacttccgacatcgccgacggcattatctgggcctcgggcggcactgtctcgggcgtgaccaacatcgcggcccgcgcacaggtgatcaacatgtccctgggcggcggcggcgcttgcgacaccaccacccagaccgcaatcaacggcgcccgctcgcgcggcaccgtggtcgtggtcgcggccggcaacgagaaccagaacgccagcaacagcagcccggccaactgctcgggcgtgatcacggtggcggccaccaacaagtcgggcggcaaggcctcgtactcgaactacggcaccatcgtcgacgtggcggcaccgggcggcgacagcggcgcggccatcctgtcgaccctgaacgccggcaccaccaccccgggcgccgacaactacgtcggctacatgggcacctcgatggccaccccgcacgtggccggcgtggtcgcgctgatgctggcgaagaacccgaacctgaccccggacgaagtcgaagccaagctgaagtcgagcgcccgtgccttcccggcagcgtgcagcggctgcggcgccggcatcgtcgacgcctcggcggcaatcgatgccgcggtcggcaccggcaccggcacgacgatgtccgaaaccgagtcgaacaacacgatcagcaccgcgaacgctgtctcgacttccggcaccacggtcaacggcaacatgggcagcaccacggattcggactacttctcggtccagctcccggccggcaagaccctgacctcgaccctgacgccgaacgcgacctccgactacgacctgtacatctacaacagcgccggcacccagatcacgtcgagcaccaacggtacgggttcggtggattcggcaagcgtgatcaacaacggcacgaccaccacgaccgcttacgtgcgcgtgaagtactacagcggcggcaccggttcgaccagcggtacgtacacgctgaagctgagctggtaa

SEQ ID NO: 62 - protein, 607 aa, Unknown
  Obtained from an environmental sample.
  SIGNAL (1)...(40)
MKSRKSMYPAVLKLCAAAVLGLGASAAFAGVPAGAATASAAQGAGMLDQTDRLIVKYKGESAPSAKGLTRAAAYVPMAASRKAVVDQVGRKHSLTVQELHAIGTGARVLKLNRKVSVAEAAKLAAELAASDASVEYAEPDRIMKPMFTPNDTYYNQQWDYFDAVGGMNMPAAWDKSTGTGIRVAVIDTGYRPHVDLQGQILAGYDFIIDTAISNDGNGRDSDASDPGDWTVAGQCGTGSAASNSSWHGTHVAGTIAALTNNGMGVAGVAYNAKVVPVRVLGQCGGYTSDIADGIIWASGGTVSGVTNIAARAQVINMSLGGGGACDTTTQTAINGARSRGTVVVVAAGNENQNASNSSPANCSGVITVAATNKSGGKASYSNYGTIVDVAAPGGDSGAAILSTLNAGTTTPGADNYVGYMGTSMATPHVAGVVALMLAKNPNLTPDEVEAKLKSSARAFPAACSGCGAGIVDASAAIDAAVGTGTGTTMSETESNNTISTANAVSTSGTTVNGNMGSTTDSDYFSVQLPAGKTLTSTLTPNATSDYDLYIYNSAGTQITSSTNGTGSVDSASVINNGTTTTTAYVRVKYYSGGTGSTSGTYTLKLSW

SEQ ID NO: 63 - DNA, 1869 bp, Archea
atgaccggcatcgaatggaaccacgagaccttttctaagttcgcctacctgggcgacccgaggatacggggaaacttaatcgcgtacaccctgacgaaggccaacatgaaggacaacaagtacgagagcacggttgttgttgaagaccttgaaacgggctcaaggcgcttcatcgagaacgcctcaatgccgaggatttcgccagacggcagaaagctcgccttcacctgctttaacgaggagaagaaggagaccgagatatgggtggccgatatccagaccctgagcgccaagaaagtcctctcaactaaaaacgtccgctcgatgcagtggaacgacgattcaaggagactcttagttgtcggcttcaagaggagggacgatgaggacttcgtctttgacgacgacgtcccggtctggttcgacaatatgggattctttgatggagagaagacgacgttctgggttcttgacactgaggccgaggagataatcgagcagttcgagaagccgaggttttcgagtggcctctggcacggcgatgcgatagttgtgaacgtcccgcaccgcgaggggagcaagcctgccctgttcaagttctacgacatagtcctatggaaggacggggaggaagagaagctcttcgagagggtctccttcgaggcggttgactccgacggaaagagaatactcctgaggggcaagaaaaaaaagcggttcatcagcgagcacgactggctgtacctctgggacggcgagcttaaaccgatctacgagggcccgctcgacgtctgggaagccaagctcacggaaggaaaggtctacttcctcactccagatgcgggcagggtaaacctctggctctgggacgggaaggccgagcgtgttgttaccggcgaccactggatttacgggcttgacgtcagcgatggcaaagcattgctcctcatcatgaccgccacgaggataggcgagctctacctctacgacggcgagctgaaacaggtcaccgaatacaacgggccgatattcaggaagctcaagaccttcgagccgaggcacttccgcttcaagagcaaagacctcgagatagacggctggtacctcaggccggaggttaaagaggagaaggccccggtgatagtcttcgtccacggcgggccgaagggcatgtacggacaccgcttcgtctacgagatgcagctgatggcgagcaagggctactacgtcgtcttcgtgaacccgcgcggcagcgacggctatagcgaagacttcgcgctccgcgtcctggagaggactggcttggaggactttgaggacataatgaacggcatcgaggagttcttcaagctcgaaccgcaggccgacagggagcgcgttggaataacgggcataagctacggcggcttcatgaccaactgggccttgactcagagcgacctcttcaaggcaggaataagcgagaacggcataagctactggctcaccagctacgccttctcggacatagggctctggtacgacgtcgaggtcatcgggccaaatccgttagagaacgagaacttcaggaagctcagcccgctgttctacgctcagaacgtgaaggcgccgatactcctaatccactcgcttgaggactaccgctgtccgctcgaccagagccttatgttctacaacgtgctcaaggacatgggcaaggaagcctacatagcgatattcaagcgcggcgcccacggccacagcgtccgcggaagcccgaggcacaggccgaagcgctacaggctcttcatagagttcttcgagcgcaagctcaagaagtacgaggagggctttgaggtagagaagatactcaaggggaatgggaactga

SEQ ID NO: 64 - protein, 622 aa, Archea
MTGIEWNHETFSKFAYLGDPRIRGNLIAYTLTKANMKDNKYESTVVVEDLETGSRRFIENASMPRISPDGRKLAFTCFNEEKKETEIWVADIQTLSAKKVLSTKNVRSMQWNDDSRRLLVVGFKRRDDEDFVFDDDVPVWFDNMGFFDGEKTTFWVLDTEAEEIIEQFEKPRFSSGLWHGDAIVVNVPHREGSKPALFKFYDIVLWKDGEEEKLFERVSFEAVDSDGKRILLRGKKKKRFISEHDWLYLWDGELKPIYEGPLDVWEAKLTEGKVYFLTPDAGRVNLWLWDGKAERVVTGDHWIYGLDVSDGKALLLIMTATRIGELYLYDGELKQVTEYNGPIFRKLKTFEPRHFRFKSKDLEIDGWYLRPEVKEEKAPVIVFVHGGPKGMYGHRFVYEMQLMASKGYYVVFVNPRGSDGYSEDFALRVLERTGLEDFEDIMNGIEEFFKLEPQADRERVGITGISYGGFMTNWALTQSDLFKAGISENGISYWLTSYAFSDIGLWYDVEVIGPNPLENENFRKLSPLFYAQNVKAPILLIHSLEDYRCPLDQSLMFYNVLKDMGKEAYIAIFKRGAHGHSVRGSPRHRPKRYRLFIEFFERKLKKYEEGFEVEKILKGNGN

SEQ ID NO: 65 - DNA, 1740 bp, Unknown
  Obtained from an environmental sample.
atgtcccaggtaacgcaaccgcgtgtgcgtcgagtgtgggtggtccttggtgcgtccgttctgtcatcgctgctgctggccacgcctgcgctggccggtgatgtccagctcagcggcctgcagtccgcacagacccaccagcgtttcatcgtgaagtaccgcgacggcagcgcgccggtggccaacaccaccgcactggcctcttcgctgaagagcgccgccgccggcctggccagcagccagggccgcgcgctgggcctgcagcaggtccgcaagctggccgtcggccccaccctggtcaagaccgatcgtccgctcgaccaggccgaatccgagcagctgatgcgcaagctggccgccgacccgaacgtggaatacgttgaagtcgaccagatcatgcgtgccacgctgaccccgaacgacacccgcttcagcgagcaatggggcttcggtacctccaatgccggcatcaacatccggccggcctgggacaaggccaccggcaccggcgtggtcgtggcggtgatcgacaccggcatcaccaaccacgccgacctcaatgccaacatcctgcccggttacgacttcatcagtgatgcggcgatggcgcgcgacggcaacggccgcgacaacaacccgaacgatgagggtgactggtacggcgacaacgagtgccaggcaggctacccgggttccaactccagctggcacggtacccacgtggccggcacggtggcggcggtgaccaacaacagcaccggcgtggcaggtactgcgttcaacgccaaggtcgtgccggtgcgcgtactcggcaagtgcggcggttacacctccgacattgccgacgcgatcgtgtgggcgtccggcggcagcgtcagcggcgtgccggccaatgccaatccggccgaggtcatcaatctctcgctcggcggtggcggcagctgctcgagcacctaccagaacgcgatcaatggcgctgtcgggcgtggcaccaccgtggtggtcgctgccggcaacagcaacaccaacgtgtcctcgtcggttcccgccaactgcccgaacgtgatcgcagtggcggccaccacctcggccggtgcgcgtgccagcttctccaactatggcaacggcatcgacatctcggcaccgggccagggcatcctgtccaccctcaacagcggcaccaccaccccgggcagcgccagctacgcttcgtacaacggcacctcgatggcggcaccgcacgtggccggcgtagtcgcgctgatgcagtccgtagccccgagcccgctgagcccggcgcaggtggagagcatcatcaagagcactgcacgtccgctgccgggcgcctgctcgggcggctgcggcgccggcatcatcgacgccgacgcggccgtggccgcggcgatcaacggcggtggcccgaatccgggcggcaacgtgctgcagaacaacgttccggtgaccggcctcggcgctgccagcggcgcttcgttgagctacacggtcaacgttccggccggcagcacccagctgcgcgtggcgatcagtggcggcagcggtgatgccgatctgtacgttcgccagggcagtgctccgactgataccgcctacacctgccgcccgtacctgagcggcaacagcgagacctgcaccatcaacagtccggccgccggcacctggtatgtgcgggtgaaggcctacagcaccttctcgggcctgaccctcaacgcccagtactga

SEQ ID NO: 66 - protein, 579 aa, Unknown
  Obtained from an environmental sample.
MSQVTQPRVRRVWVVLGASVLSSLLLATPALAGDVQLSGLQSAQTHQRFIVKYRDGSAPVANTTALASSLKSAAAGLASSQGRALGLQQVRKLAVGPTLVKTDRPLDQAESEQLMRKLAADPNVEYVEVDQIMRATLTPNDTRFSEQWGFGTSNAGINIRPAWDKATGTGVVVAVIDTGITNHADLNANILPGYDFISDAAMARDGNGRDNNPNDEGDWYGDNECQAGYPGSNSSWHGTHVAGTVAAVTNNSTGVAGTAFNAKVVPVRVLGKCGGYTSDIADAIVWASGGSVSGVPANANPAEVINLSLGGGGSCSSTYQNAINGAVGRGTTVVVAAGNSNTNVSSSVPANCPNVIAVAATTSAGARASFSNYGNGIDISAPGQGILSTLNSGTTTPGSASYASYNGTSMAAPHVAGVVALMQSVAPSPLSPAQVESIIKSTARPLPGACSGGCGAGIIDADAAVAAAINGGGPNPGGNVLQNNVPVTGLGAASGASLSYTVNVPAGSTQLRVAISGGSGDADLYVRQGSAPTDTAYTCRPYLSGNSETCTINSPAAGTWYVRVKAYSTFSGLTLNAQY

SEQ ID NO: 67 - DNA, 1854 bp, Unknown
  Obtained from an environmental sample.
gtgatcaagaagcagaaccttcgcatcaatgtgcttgccgccgccgtgctgtcgatgacggctgtcggtgccgtccacgccgccggcctgccgacccgtgagccggtgcgccaggccagcaccgcccaaccgggcgccgagcgcatcatcgtcaagtaccgggctggcgctgctgccgccaccgaccgctcggcgaagctgtctaccgtgcaatcggcgctgacccgggccagcctgtccggcggtacctcacgtgccagtaccctcggcccgcaggtggtacgcaagctcgctaccggtgcggacctgatccgcgtgcagggccgcctggccccggccgaactgcagcgtgtgctgaaggaactgcaggccgacccgtcggtgcagtacgccgaagccgacgtgaagctgcgccgcaccgagctgcgtgccggcgatgtgcagccggcactggtgccgaacgatcccttctaccagcagaaccagtggcacctgcacaatgcggtcggcggcatcaacgcaccggcggcatgggatgtctcgcagggcgaaggcatcgtggtggcggtgatcgataccggcatcctgccgcagcatccggacctggttggcaacctgttggagggttacgatttcatcagcgacgccgagacctcgcgccgcccgaccaatgatcgtgtgccaggcgcgcttgaccagggcgactgggtggagaacgacaacgagtgctacgacggctcgctggccgaggacagctcctggcacggcacccatgtggccggtaccgtcgccgagcagaccaacaatggcgtcggcatggccggtgtcgcctacaaggccaaggtgctgccggtgcgcgtgctgggcaagtgcggcggctacctgtccgacatcgccgacgcggtggtctgggcatcgggtggcacggtgaccggcatcccggccaacaccaacccggccgagatcatcaacatgagcctgggcggcagcggcgcctgcggcagcacctaccaggacgccatcaacggcgccatctcgcgcggtaccacggtggtggtggcggccggcaatgagaccgacaacgcgtccaagtaccgtccggccagctgcgaaggcgtggtgaccgtgggtgcgacccgtatcaccggcggcatcacctactactccaactacggcacccgcgtggatctgtccggcccgggcggcggtggcagcgtcgacggcaatcccggtggctacatctggcagaccggctccaatgcggcgaccacgccggattcgggtacgccgggctacatgggcatgggcggcacctcgatggcctcgccgcatgtggccgccgttgctgcactggtgcagagcgcgctgatcgccaagggcaaggatccgctgaccccggcggccatgcgcaccctgctgaaggaaaccgcgcgtccgttcccggtcgccatcccggcggccaccccgatcggtaccggcatcctcgacgccaaggccgcgctggccaaggcactggaagagccgtgcaccgagaactgcggaccggtggccacgccgctgaccaacaaggcggccatcggcggtctgtccggtgcggctggcagcagcaagctttacagcttcgaagcggccgccggcaagcagttcagcgtgatcacctacggcggcaccggcaatgtttcggtctacgtggctgaaggccgtgagcccagtgccagcgacaacgacgccaagtcgacccgtccgggcacctccgagacagtgcgggtgaccaagccggtggcggccacctactacatcaaggtggtgggtgaagcggcctacaacggggtgagcattctcgccacgcagtaa

SEQ ID NO: 68 - protein, 617 aa, Unknown
  Obtained from an environmental sample.
  SIGNAL (1)...(27)
MIKKQNLRINVLAAAVLSMTAVGAVHAAGLPTREPVRQASTAQPGAERIIVKYRAGAAAATDRSAKLSTVQSALTRASLSGGTSRASTLGPQVVRKLATGADLIRVQGRLAPAELQRVLKELQADPSVQYAEADVKLRRTELRAGDVQPALVPNDPFYQQNQWHLHNAVGGINAPAAWDVSQGEGIVVAVIDTGILPQHPDLVGNLLEGYDFISDAETSRRPTNDRVPGALDQGDWVENDNECYDGSLAEDSSWHGTHVAGTVAEQTNNGVGMAGVAYKAKVLPVRVLGKCGGYLSDIADAVVWASGGTVTGIPANTNPAEIINMSLGGSGACGSTYQDAINGAISRGTTVVVAAGNETDNASKYRPASCEGVVTVGATRITGGITYYSNYGTRVDLSGPGGGGSVDGNPGGYIWQTGSNAATTPDSGTPGYMGMGGTSMASPHVAAVAALVQSALIAKGKDPLTPAAMRTLLKETARPFPVAIPAATPIGTGILDAKAALAKALEEPCTENCGPVATPLTNKAAIGGLSGAAGSSKLYSFEAAAGKQFSVITYGGTGNVSVYVAEGREPSASDNDAKSTRPGTSETVRVTKPVAATYYIKVVGEAAYNGVSILATQ

SEQ ID NO: 69 - DNA, 1740 bp, Unknown
  Obtained from an environmental sample.
atgtcccaggtaacgcaaccgcgtgtgcgtcgagtgtgggtggtccttggtgcgtccgttctgtcatcgctgctgctggccacgcctgcgttggccggtgacgtccagctcagcggcctgcagtccgcgccgacgcatcagcgcttcatcgtgaagtaccgcgacggcagtgcgccggtggccagcaccaccgcactggcttcttcgctgaagagtgccgccgccggcctggccagcagccagggccgcgcgctgggcctgcaggaggtccgcaagctggccgtcggcccgaccctggtcaggaccgaccgtccgctcgaccaggccgaatccgagctgctgatgcgcaagctcgccgcggacccgaacgtggaatacgtcgaagtcgaccagatcatgcgtgcgacgctgaccccgaacgacacccgcttcagcgaacaatggggcttcggtacctccaacgcgtcgatcaacgtgcagccggcctgggacaaggccaccggcaccggcgtggtggtggccgtgatcgataccggcatcaccaaccatcccgatctcaacgccaacatcctgccgggctatgacttcatcagcgacgccgcgatggcgcgcgatggcggcggccgcgacagcaacccgaatgacgagggcgactggtacggcgccaatgagtgcggctcgggcattccggcctccaactccagctggcacggtacccacgtcgccggcaccgtggcggcggtgaccaacaacagcaccggcgtggccggtactgcgttcaatgccaaggtcgtcccggtgcgcgtgctcggcaagtgcggcggttacacctccgacatcgccgacgcgatcgtgtgggcttctggcggcacggtcagtggcgtgccggccaatgccaacccggccgaagtcatcaacatgtcgctgggcggcggcggcacctgctcggccacctaccagaatgcgatcaacggcgcggtcagccgtggtaccaccgtggtggttgccgccggcaacagcaacaccaacgtgtcctcgtcggtgccggccaactgcgcgaacgtgatcgcggtggcggccacgacctcggccggtgcgcgtgccagcttctccaactacggtgccggcatcgacatttcgggcccgggccagagcatcctgtccaccctcaacaccggcaccaccacgccgggcagcgccagctacgcgtcctacaacggcacctcgatggcggcgccgcatgtggccggcgtggttgcactgatgcagtcggtggcgccgagcgcactgagtccggcacaggtcgaaagcatcatcaagagcaccgcacgcccgctgccgggcgcctgctcgggtggctgcggcgccggcatcgtcgatgccaacgcggccgtggccgcagcgatcaatggcggtggcccgaacccgggcggcaatgtgctgcagaacaacgtgccggtgaccggcctgggcgccgcaaccggtgccgagctgaactacaccgtcgcggttccggccggcagctcacagctgcgcgtggcgatcagtggcggcagcggtgatgccgacctgtacgtgcgccagggcagtgccccgaccgataccacttacacctgccgtccgtacctgagcggcaacagcgagacctgcaccatcaacagccctgccgccggcacctggtatgtgcgggtgaaggcgtacagcaccttctcgggcctgaccctcaacgcccagtactga

SEQ ID NO: 70 - protein, 579 aa, Unknown
  Obtained from an environmental sample.
  SIGNAL (1)...(32)
MSQVTQPRVRRVWVVLGASVLSSLLLATPALAGDVQLSGLQSAPTHQRFIVKYRDGSAPVASTTALASSLKSAAAGLASSQGRALGLQEVRKLAVGPTLVRTDRPLDQAESELLMRKLAADPNVEYVEVDQIMRATLTPNDTRFSEQWGFGTSNASINVQPAWDKATGTGVVVAVIDTGITNHPDLNANILPGYDFISDAAMARDGGGRDSNPNDEGDWYGANECGSGIPASNSSWHGTHVAGTVAAVTNNSTGVAGTAFNAKVVPVRVLGKCGGYTSDIADAIVWASGGTVSGVPANANPAEVINMSLGGGGTCSATYQNAINGAVSRGTTVVVAAGNSNTNVSSSVPANCANVIAVAATTSAGARASFSNYGAGIDISGPGQSILSTLNTGTTTPGSASYASYNGTSMAAPHVAGVVALMQSVAPSALSPAQVESIIKSTARPLPGACSGGCGAGIVDANAAVAAAINGGGPNPGGNVLQNNVPVTGLGAATGAELNYTVAVPAGSSQLRVAISGGSGDADLYVRQGSAPTDTTYTCRPYLSGNSETCTINSPAAGTWYVRVKAYSTFSGLTLNAQY

SEQ ID NO: 71 - DNA, 1620 bp, Unknown
  Obtained from an environmental sample.
atgcaacgatcacgacgcctcgtcgtcacggtgttgacgctggcactctgcctgatggcggtaccggccggcgctgccgctcctgaccagcctgcggcccccgaaggggtgcccggcgcccccgatcggatacccgccgcgaccgagacgccggacacgcctctgcccggagccgatcgtgccgctggcgagcccgcccccgtgctgggctccgaccatcccgaggcgatcgaggggcgctacatcgtcgtgttccgcgaggatgccgcacagggtgaggtagcccgggcggccgagcgggccaccgctcgcggcgcgacggtgcacgccacgtaccgccacgccctgcacgggttcgcggccaccctccccgagcaggcgctgggggcgctcacgcgcaacccgaacgtcgcgttcatcgacgcggaccttgccgtctcgatcgagcaggtgcagagccccgcgacctggggcctggaccgcatcgaccagcggcgcctgccgctggacaaccaataccactacacccacaccggcgcgggcgtgcacgcctacatcatcgacaccgggatccacgacacccacgccgagttcggcggtcgcgcgcacctcgcgttcacggcgatccacgacggcctcggcgcccgcgactgcagcggccacggtacccacgtcgcgggcaccgtcgggggccagacctacggcgtcgcgaaggccgtgcagctgtactccgtccgggtgctcgactgcctgggcggcggcacgatggctggcgtcatcaacggcgtcgactgggtcacggccaaccacgtcaagccagccgtggccaacatgagcctcggcggcctggccagctcggcgctcgacacggccgtgaacaactcgatcaacgccggggtccactacgtcgtggccgctgccaacagcagcgccgacgcgtgcggcttctcccccgctcgggtgagccgggcgctgacggtcggcgccagcaccagttcggacgcgcgcgcggcattcagcaactacggaacctgcgtcgacctgttcgcccccggccagagcatcacgtcggcatggcacacgagcaacacggcgacgaatacgagcagcggcacgtcgatggccgcgccgcacgtcgctggtgtcgtcgccctgtatctgcagcagggcaaccagacgcccgcatgggtccacggcgtggtcacgagccagtcgacgcatgggctgctgagcgggatcgggccgggttcgccgaaccgcctgctgtactccctgatccccgcgcgcatcaccaccgcggccccttgcagctaccccgagcggttccgcgggttgctggcgcggacgggtgactggcatttcctgccggtgattccggagtacgggtacaactcgcaggcaggggtccatcgcgcctgcgtgaccggccccgccggcgcgaccctaggcctgcacctgttctggtggaacggctcccagtggcaactcgtccgcagcgcccagtcggtgaacggttcagtcgccagcatcacgcacagtggcgccgccgggtggtacacctggcgagtggattcgacgtccggctcgggcacctacaccttctcgatgcagcgaccgtag

SEQ ID NO: 72 - protein, 539 aa, Unknown
  Obtained from an environmental sample.
  SIGNAL (1)...(25)
MQRSRRLVVTVLTLALCLMAVPAGAAAPDQPAAPEGVPGAPDRIPAATETPDTPLPGADRAAGEPAPVLGSDHPEAIEGRYIVVFREDAAQGEVARAAERATARGATVHATYRHALHGFAATLPEQALGALTRNPNVAFIDADLAVSIEQVQSPATWGLDRIDQRRLPLDNQYHYTHTGAGVHAYIIDTGIHDTHAEFGGRAHLAFTAIHDGLGARDCSGHGTHVAGTVGGQTYGVAKAVQLYSVRVLDCLGGGTMAGVINGVDWVTANHVKPAVANMSLGGLASSALDTAVNNSINAGVHYVVAAANSSADACGFSPARVSRALTVGASTSSDARAAFSNYGTCVDLFAPGQSITSAWHTSNTATNTSSGTSMAAPHVAGVVALYLQQGNQTPAWVHGVVTSQSTHGLLSGIGPGSPNRLLYSLIPARITTAAPCSYPERFRGLLARTGDWHFLPVIPEYGYNSQAGVHRACVTGPAGATLGLHLFWWNGSQWQLVRSAQSVNGSVASITHSGAAGWYTWRVDSTSGSGTYTFSMQRP

SEQ ID NO: 73 - DNA, 1836 bp, Unknown
  Obtained from an environmental sample.
atgcaacagcacagcaagatggcccccgtgttgaagttttgcgcggcggccctgatcgccctggggtcgacggcagcccacgccggtccgcacgacgcggcatcaccccgcttcatcacccagaccgaccgcctgatcatccgctacaaggatgcggtcgacacctcgaagtcccagacgccggtggccccgcgtcccattcccgaggcacgcaaggcccagctcgaccgcgccggccagggcttcggcgcgaccctgcgcgcactgcgcgcgaccgccaacggcgcccacgtcctgcagctcagccgcaccatgtcgctggacgaagcgaagcagctggcggccgacctgaaggcgcgcgacgccaacgtcgagtacgccgagccggaccgcatcatgaccgcgctggccacgccgagcgaccccagctacagccagcagtgggacctgtatgaagccaagggcggcatcaacgtgcaggccgcctgggacaagtcgaccggcagcggcatcaacgtggccgtgatcgacaccggctaccgtccgcatgccgacctggccggccagatcctgcaaggctacgatttcatcaccaacaccaccatggccaacgacgggggcggccgcgacagcgacgccagcgatccgggcgactggaccccggccggcagctgctcggcaggtacgccggcccaggaccaggcctccggctggcacggcacccacgtggccggcaccatcgccgcgcgcgccaacaacggcgccggcatcgcgggcatcgcctacaacgccaagatcgtcccggcgcgcgtgctgggccgctgcggcggctacacctcggacatcgccgacgccatcgtctgggcttcgggcggcagcgtgaacggcgtgccggcgaatgccaacaaggcgcgcgtgctgaacctgtcgctgggcggcagcggcggctgcgacagcacgacccagaacgccatcaacagtgcgcgctcgcgcggcgcggtggtcgtggtcgccgccggcaattcgaacgtcgatgccgcgggctccagcccggccaactgcgccggcgtgatcgcggtggcggcggtcggccgcagcggcggcaaggcctcgtactcgaactacggcaacacggtcgacgtggcggcgccgggcggcgacagcggcgccggcatcctgtcgacgctgaacagcggcaccaccaccccggccggcgacagctacgcctactacatgggcacctcgatggccgccccgcacgtggccggcgtggccgcgctgatgctgtcggcgaacccgaacctgaccccggacgaggtcgaggccaagctgaagtcgaccgcgcgcgccttcccggccacctgcaacggctgcggcagcggcatcatcgacgccgcagccgccgtcaacgcgtcgctgcctgccggcagcacgcccacgccgccggcatcgggctggaccgaatgcgcgcccgaaaacggcacctgctcgttcagcggcacccgtgaagtacgctacggcgccggtaccagcttcgtctcgaagatcgtgaccggttccgtcgcctgctcgaacgccgtgttcggcgatccgctgccgaacgtggtcaagtcgtgcagctattcgaacgccacggtgagcgtgccgacctggaccaactgcgcgggcgagggcggcacctgctcgttcagcggcacccgcgaagtgcgctacggcgccaacaacaacttcgtgtcgcgcgtcttcaccggcgccgccgtgtgctcgaatgccaccttcggcgatccggtgccgaacgtggtcaaggcctgcagctattccagcgtcacgcaataa

SEQ ID NO: 74 - protein, 611 aa, Unknown
  Obtained from an environmental sample.
  SIGNAL (1)...(28)
MQQHSKMAPVLKFCAAALIALGSTAAHAGPHDAASPRFITQTDRLIIRYKDAVDTSKSQTPVAPRPIPEARKAQLDRAGQGFGATLRALRATANGAHVLQLSRTMSLDEAKQLAADLKARDANVEYAEPDRIMTALATPSDPSYSQQWDLYEAKGGINVQAAWDKSTGSGINVAVIDTGYRPHADLAGQILQGYDFITNTTMANDGGGRDSDASDPGDWTPAGSCSAGTPAQDQASGWHGTHVAGTIAARANNGAGIAGIAYNAKIVPARVLGRCGGYTSDIADAIVWASGGSVNGVPANANKARVLNLSLGGSGGCDSTTQNAINSARSRGAVVVVAAGNSNVDAAGSSPANCAGVIAVAAVGRSGGKASYSNYGNTVDVAAPGGDSGAGILSTLNSGTTTPAGDSYAYYMGTSMAAPHVAGVAALMLSANPNLTPDEVEAKLKSTARAFPATCNGCGSGIIDAAAAVNASLPAGSTPTPPASGWTECAPENGTCSFSGTREVRYGAGTSFVSKIVTGSVACSNAVFGDPLPNVVKSCSYSNATVSVPTWTNCAGEGGTCSFSGTREVRYGANNNFVSRVFTGAAVCSNATFGDPVPNVVKACSYSSVTQ

SEQ ID NO: 75 - DNA, 2262 bp, Unknown
  Obtained from an environmental sample.
atgtccagatcacatcacactgtactactgatcggcgttagcttactggcaagcgcagtatcaaatgctatggccgcatcaacagactcattgcgccaggcagcagaacaagccagcagcgatcgctatatcgtaaaatataaagacaacagtctgagtaaagatccacttctcaaccgcagtaaagctgcaaaagatagtgcgctatcagcattaacctctaacagcgaacgtttaagccggcaaggtgcacgtgttcaccatgttctggccaaacgtaacgccatagcagccgagctaagccctgccacggttaaagcgttaaaagcagatcctaatgtggaatatgtcgagcgcgatttaccgcgttttcctatgtcgcagcaagtgccttacggttataccatggtgcaggccgatctggtcagtgatcagtttgcctctaaccagacggtatgtgttatcgactctggcctgggcttaccacatgaagactttaacgatgccaatatcaccggcaccaatgatataggtaccggtaactggttcgacgccggtggcccacacggtacacatgtagccggtaccattgctgcgctgaataataatgttggtattgttggcgtattgcccaacggcaatgtgaaactgcatatcattaaagtatttaacgccggtggctggggttactcttccactctggcacatgcggtagatacctgtgtgcaaaacggctctaccgtaattaatatgagcttaggcggtgccggctcaaacgtaacagagcgtaacgccatgcaggccgcctatgacgccggtgtgttacttgttgcagcagcgggtaatggcggcaatactgccatgtcgtatccggcttcttatgattctgtcgtatcagttgcagcggttgacgacaccaaagcccacgctgacttttcgcagcgtaatacccaggtagaactggcaggcccgggtgtagcggtaatgagtacttatccaaccggtacaggcctggaaaccagcctgacggttaacggtacaacctacagtaccaacccgttcgaaggctctgccatggccagtttgaatgcggaactggccagctgcggccttgcggtaaatacctgtaccggcgttaccgataaaatctgtctgatccagcgcggcgaagtatctttcgcacaaaaagtggaatcctgtcaggctggcggtggtattggcgcggttatttataacaacgaaccaggcaatttcagcggcaccttaggtgacgcccccactactaatatagtagcgttaagcgtatcgcaggaagatggccagttgttggttgcagaagtaggtaacgatgccagcttatttgccggcccgtctaactatggcctgatggacggtacctctatggcgtcgccgcatgtagccggtgtagcagcattggtatggagccattacccggattgtagcaatgcacaaatccgcagtgctttagcagcaacagcagaagatttaggcgccgctgggcgtgatacatcttatggctatggcttggtacaagccaaagccgcggtagattatctggccgagtttggctgtgacggcgacggtgacgataacgagccaccaccaccaaccggcacagaactgagtaacggtgtaacagtatcaggcatcagtgctgctgccggtgaagaactgctgtacacgctggccgtacctgcaggtgccagcaacctgtcgtttgttatgaatggcggtaccggcgatgccgatctgtatgtcaagtttggcagcgagccaaccgcatcaaactgggactgccggccttacctgtttggtaacaacgaaagctgtgctatcgacccggcacaaaccggtacttactttgttaagttagtagcatacagcgcctttaccggtgtaaaccttaccggtagctttaccgcaccggatttaccggatgcaggcggcgaaaccattaccaacatcaacatagcgcgccgggcctggcagcactacacgctggacgtaccggaaggtatggcacagctaactgttgaaatcagtggtggcagcggtgatgctgatctgtacgtgaagcatggcagccagcctaccagcggtagctatgattgccggccaaataaaaacggcaatagcgaaacctgtgttattaacaacccgcaagccggtgtatggcatctgtcagtttatgccttccgggcggtaagcggcttaacactggtaagtgaataccaaccgtaa

SEQ ID NO: 76 - protein, 753 aa, Unknown
  Obtained from an environmental sample.
  SIGNAL (1)...(25)
MSRSHHTVLLIGVSLLASAVSNAMAASTDSLRQAAEQASSDRYIVKYKDNSLSKDPLLNRSKAAKDSALSALTSNSERLSRQGARVHHVLAKRNAIAAELSPATVKALKADPNVEYVERDLPRFPMSQQVPYGYTMVQADLVSDQFASNQTVCVIDSGLGLPHEDFNDANITGTNDIGTGNWFDAGGPHGTHVAGTIAALNNNVGIVGVLPNGNVKLHIIKVFNAGGWGYSSTLAHAVDTCVQNGSTVINMSLGGAGSNVTERNAMQAAYDAGVLLVAAAGNGGNTAMSYPASYDSVVSVAAVDDTKAHADFSQRNTQVELAGPGVAVMSTYPTGTGLETSLTVNGTTYSTNPFEGSAMASLNAELASCGLAVNTCTGVTDKICLIQRGEVSFAQKVESCQAGGGIGAVIYNNEPGNFSGTLGDAPTTNIVALSVSQEDGQLLVAEVGNDASLFAGPSNYGLMDGTSMASPHVAGVAALVWSHYPDCSNAQIRSALAATAEDLGAAGRDTSYGYGLVQAKAAVDYLAEFGCDGDGDDNEPPPPTGTELSNGVTVSGISAAAGEELLYTLAVPAGASNLSFVMNGGTGDADLYVKFGSEPTASNWDCRPYLFGNNESCAIDPAQTGTYFVKLVAYSAFTGVNLTGSFTAPDLPDAGGETITNINIARRAWQHYTLDVPEGMAQLTVEISGGSGDADLYVKHGSQPTSGSYDCRPNKNGNSETCVINNPQAGVWHLSVYAFRAVSGLTLVSEYQP

SEQ ID NO: 77 - DNA, 2136 bp, Unknown
  Obtained from an environmental sample.
atgcctcacgtcaaatttggaaccagtgatgaaccgggattcgagttggaagagagtggcgacctgatcgcggtgcgtacccacagccggcgttcggtcgtgggtgcgggtccggtgatgccgcccacggctgccgaagtcagtgatggcgaactcgtggccagttttcccgaggctggggtcgaggtgtaccgagtgcccgccgctgatcgctcactcgaccaacggaagctggaactacgggcggcccctgacgtgcagttcgccggttcggtgctggtccgcccaggttcggacgaacctgtgctgtatacggagaacctgtatatccgcttccgggaggatctcgatccggatgactgcgaagcgatcatccgtcaggctggcctgacggtgaagcaacgtctggatttcgccaccaacgcctacttcctggccgctcccgaggggacgggacagcgcgtcttcgacatcgcgttggagctgttgaagcgcaacgacgtgatctattgccatccggaactgatcgagcgacgcgtacacaagcaacgcatctttcctgaacaatggcacctgaaggcgaccagcatcaatggcacggcggtgaatgcccatgcgaatgtcggggcggctcacgccatcacgctgggcgccggggtcacgatcgcggtcatcgacgacggggtggacatcgatcacccggagttcagcgcaacgggcaagattattgcccctcgcgacgccacgttgcaaacgaatgatccccgtccaaaggacacggtcccgagtcggcgcggggaaaaccatggcacggcgtgcgccggcgtggcatgcgccggtggaaccgatggtgcggccggcgttgctccgctggcccggctgatgcccattcggttgcgaagtggcctggggtcggttcgcgaggccgaggccttccaatgggcagccgacaatggagcggacatcatctcgtgcagttggggaccgcgcgacggggactggtggaatccgaacgacccactgcacaaccatgtcttccaactgccggcgagcacccgcgacgcaatcgactacgccgtaagtgaaggccgcggaggaaaaggctgcgtcatcctgtttgccgccggcaacggaaacgagtcggtggataacgatggctatgcgagctaccacaaggtcattgcggtggcggcgtgcaacgaccgaaatacgcgcagcgtctacagcgactttggcaaggccatctggtgctcgttccccagcagtgacttcggccacgccccgttcaatcatccccagccgctgactcccggaatctggacgaccgaccggatggggcgctttggatacaaccccggaaacgtccgtttcggcgacgccgccggcaactatacgaacgactttggaggtacctccagttcctgcccgggtgcggctggcgtcgccgctttagtgctgtcggtcaatccggccctgcgttggaacgaggtgaaggatctcttacgccgcgcctgcgatcggatcgacttggcgaatggccaatacgacgccgaggggcacagccacttctatgggtacggccggctaaacgccgagacggccgtgaagctcgccaagcagtccgtggggaaactggtgattatcaacaagttgctcaacgaaccaattccggatttgggcagcgtgcagacaaccatcgacgttacggaaacggaccccgtggagaagttggctgtctcggtccgcctggagcacacctggatcggggacttggttatcacggcgattgctccgtccaacaccggacaaggaaaaatcgtcctgcacaatcgggcgggtggcagccgcaagaacattgacatgctgtacgatccttccaatactcccaagctgggtgctcttgccggaaagaagtgtagcggcacctggacgatcaaagtcgaggatcaggccgcccaggactcgggcaccttgatccaggtcggcttgcacttgtttctgccagccgctcagtcggacggtgccggggacggggcccgcgccgcggtggcctcacaagccgcgacaggaaaaacgaaacgagcggctgcgaagaaaacagccgctcgccgaacccgcgcgaagaaaaaacgataa

SEQ ID NO: 78 - protein, 711 aa, Unknown
  Obtained from an environmental sample.
MPHVKFGTSDEPGFELEESGDLIAVRTHSRRSVVGAGPVMPPTAAEVSDGELVASFPEAGVEVYRVPAADRSLDQRKLELRAAPDVQFAGSVLVRPGSDEPVLYTENLYIRFREDLDPDDCEAIIRQAGLTVKQRLDFATNAYFLAAPEGTGQRVFDIALELLKRNDVIYCHPELIERRVHKQRIFPEQWHLKATSINGTAVNAHANVGAAHAITLGAGVTIAVIDDGVDIDHPEFSATGKIIAPRDATLQTNDPRPKDTVPSRRGENHGTACAGVACAGGTDGAAGVAPLARLMPIRLRSGLGSVREAEAFQWAADNGADIISCSWGPRDGDWWNPNDPLHNHVFQLPASTRDAIDYAVSEGRGGKGCVILFAAGNGNESVDNDGYASYHKVIAVAACNDRNTRSVYSDFGKAIWCSFPSSDFGHAPFNHPQPLTPGIWTTDRMGRFGYNPGNVRFGDAAGNYTNDFGGTSSSCPGAAGVAALVLSVNPALRWNEVKDLLRRACDRIDLANGQYDAEGHSHFYGYGRLNAETAVKLAKQSVGKLVIINKLLNEPIPDLGSVQTTIDVTETDPVEKLAVSVRLEHTWIGDLVITAIAPSNTGQGKIVLHNRAGGSRKNIDMLYDPSNTPKLGALAGKKCSGTWTIKVEDQAAQDSGTLIQVGLHLFLPAAQSDGAGDGARAAVASQAATGKTKRAAAKKTAARRTRAKKKR

SEQ ID NO: 79 - DNA, 1407 bp, Unknown
  Obtained from an environmental sample.
atgcctcaagcctcttcccaggccagcaacgccttcaccgaaatcgacaccttccgccacctgtacgaccgcggcgacggtcaggtcaacggcaaaccgtcgttcaccgccgaccaggccgccgccgagatcctgcgcaagggcatgtcctggcaggacaagaacggcgacggcaagatcgacctcagctataccttcctgaccgacaagcctgccaactacaacccgaaactgggcaacttcggcgagttcagcgccctgcagaaagcccaggccgtgctcgccatgcaatcctgggccgacgtggccaacgtcaccttcaccgaaggcaacggcggcgacggccacatgacgttcggcaactacgacgtcagcaccggcggcgcggcgttcgcctacctgccccagggcagcagctacgacggccagtcgtggtacctgatcaacgaccagtaccaggtcaacaagactcccggcaccaacaactacgggcgccagaccctgacccacgaaatcggccacaccctcggcctgtcgcaccccggcgcctacaacgccggcaacggcaacccgacctacggtgacgccaagtacgccgaagacacccgcggctacagcctcatgagctactggagcgaaagcaacaccgcccagaacttcagcaaggacggcagcggcgcctacgcgtcggcgccgttgctggacgacatcgtggcggtgcagaaactctacggcgccaacctgcagacccgtgccgacgacaccgtctacggcttcaactccaacgccgagcgcgacttctacagcgccacctccaacagctccaaggtggtgttctcggtgtgggacggcggcggcaacgacaccctggacttctccggcttcagccacaaccagaagatcaacctcaatgaaggttcgttctccgacgtcggcggcctggtgggcaacgtgtccatcgcctatggcgtgaccctggagaacgccatcggcggttcgggcaacgacctgctgatcggcaacgcggcggccaacgaactggtgggcggagccggcaacgacctgatctacggcggtggcggcggcgacacgctgtggggcggggaaggggccgacaccttcgtgttcggcgcggccagcgactcgaccatgaccgcgccggactggatcatggatttcaccagcggcctggacaagatcgacctgtcgggcatcgccggcttcgccagcggcgcggccacgctgaacttcgtcagcggcttcaccggccatgcgggcgatgcgatcctcacctacttcgcgcagaccaaccagaccagcctgatgatcgacctgaccggccaaggttcggtggacttcgccgtgggcgtggtggggcaggcgctggcaagcgacatcgtcgcgtga

SEQ ID NO: 80 - protein, 468 aa, Unknown
  Obtained from an environmental sample.
MPQASSQASNAFTEIDTFRHLYDRGDGQVNGKPSFTADQAAAEILRKGMSWQDKNGDGKIDLSYTFLTDKPANYNPKLGNFGEFSALQKAQAVLAMQSWADVANVTFTEGNGGDGHMTFGNYDVSTGGAAFAYLPQGSSYDGQSWYLINDQYQVNKTPGTNNYGRQTLTHEIGHTLGLSHPGAYNAGNGNPTYGDAKYAEDTRGYSLMSYWSESNTAQNFSKDGSGAYASAPLLDDIVAVQKLYGANLQTRADDTVYGFNSNAERDFYSATSNSSKVVFSVWDGGGNDTLDFSGFSHNQKINLNEGSFSDVGGLVGNVSIAYGVTLENAIGGSGNDLLIGNAAANELVGGAGNDLIYGGGGGDTLWGGEGADTFVFGAASDSTMTAPDWIMDFTSGLDKIDLSGIAGFASGAATLNFVSGFTGHAGDAILTYFAQTNQTSLMIDLTGQGSVDFAVGVVGQALASDIVA

SEQ ID NO: 81 - DNA, 1629 bp, Unknown
  Obtained from an environmental sample.
atgaaacgcaacgtgtttgcaatcatcctgacagtattgttcgcgacagcggctcaagcggagcgtgtgatcgtgattatgaaagacaagcaagctttcaaaatggctgaccaagtgtataagatgaaggggtcttacacattaaaaggtttccatggacaagagtggagcggattgcctcaagttgaaggccaagttgaggacagcctagagcacctgaacacgcttatcatcgatgcaaaagacgatgcagcgatctccaatctagtgtcaaatccagctgttgcttatgttgaaagagaaatcttccacgaaggtcctcgtccagtgcgtggtttcgtagccgctcctttggcaaaatcaaaagccgtttctcaaaaacaaccttggggcatttctgctgtaaaagctcctgaagcatggcctctatctaatgaaggtcagggtgctcgcgttctagtacttgatactgggatcgatcaagctcacgcttctttgacgaaaaatttcgaagcgggcatggacttcactggcaagtctgacggttctgacttcacagactctgtaggtcacggaactcacgttgctggtactattgcgggtgtgaaagcaagatctggtttcacaggtgttgctcctaaagcaaaagttttggcaggtcgtgtttgttctgaaaacggttgctctaacatcgctatcgctcaaggtatcaactggggtattactcaaaacgtagacgttatctctatgtctttgggtggtatgtggtcgactcctgcagagcgtgacgccgtttctaaagcagacgctgcgggcatcactgttgtggcggcttctggtaacagcggaactccgcgtgtttctttcccggcggcattgccaacagttatcgcagtcggcgcgatcgacaatacattgaaaaaagctgatttctctcaatggggtcctgaattggctgttgttgctccgggtgtggcggttgtttcttctgttccaacgggaacgggtcgtgaagcggctgttgaaatcgctttctctgctaaatctggcaaagtaaacgcgacaactttccagggtgctaaagagatcctgaatgcagaaactaatgagttggttgctgtaggtcttggtaaaactgaagatttcgcaaaagcaaacgtaactggtaaatacgctttgatcagccgtggtgagatcactttcggtgataaagttaaaaacgcgatcgcggcgggtgctgcgggtgtggttatctacaataacgctccaggcttgatccaaggttctttgactaacgatggatctacattgtcagttccagttttcatggtggaacaaactactggtaacgatatcgtagcgtctttggaaaaaggcgaaactgtgaaagccactttgcaaactcttgcaactgactactctgctttcgacggtacttctatggcaactccacacgtatctggtgtagtggctcttatgaaagcggcaaacaaggctttgacgggcgctcaagtaaaagacatcttgaagcaaacagctcaagctttgggaccaaacgatgaaaaccaatacggtgcgggtttggtaaatgcggaagcggcagtcaatgctgcgatccaggcaaaataa

SEQ ID NO: 82 - protein, 542 aa, Unknown
  Obtained from an environmental sample.
  SIGNAL (1)...(20)
MKRNVFAIILTVLFATAAQAERVIVIMKDKQAFKMADQVYKMKGSYTLKGFHGQEWSGLPQVEGQVEDSLEHLNTLIIDAKDDAAISNLVSNPAVAYVEREIFHEGPRPVRGFVAAPLAKSKAVSQKQPWGISAVKAPEAWPLSNEGQGARVLVLDTGIDQAHASLTKNFEAGMDFTGKSDGSDFTDSVGHGTHVAGTIAGVKARSGFTGVAPKAKVLAGRVCSENGCSNIAIAQGINWGITQNVDVISMSLGGMWSTPAERDAVSKADAAGITVVAASGNSGTPRVSFPAALPTVIAVGAIDNTLKKADFSQWGPELAVVAPGVAVVSSVPTGTGREAAVEIAFSAKSGKVNATTFQGAKEILNAETNELVAVGLGKTEDFAKANVTGKYALISRGEITFGDKVKNAIAAGAAGVVIYNNAPGLIQGSLTNDGSTLSVPVFMVEQTTGNDIVASLEKGETVKATLQTLATDYSAFDGTSMATPHVSGVVALMKAANKALTGAQVKDILKQTAQALGPNDENQYGAGLVNAEAAVNAAIQAK

SEQ ID NO: 83 - DNA, 3048 bp, Unknown
  Obtained from an environmental sample.
atgaataacaagcacaacaacctggccatgctttgcgcattggccaccctcggtaccgcacacgcggcgccttacgtggaaaacggtagagcaggcgatcccaacagttggcgcagcactgaattcaatgccgattgggggctgggagcggtcaacgcacaggaggcctacgctgccggttacaccggcaaaggcgtgaagctggggatcttcgaccaaccggtctacgccgcgcatccggagttttccggccccaacaaagtgatcacgctggtcaccagcggcatccgcgaatacaccgatccgtacatcccggtcaaagcgggagacgcctttcgctacgacggttcgccctcgataggttccgacggcaagctgggggcccacggcacccacgttggcgggattgctgccggcagtcgcgatggcggtccgatgcatggtgtggcgtttggcgcgcagatcatcagtgcggacaacggagatccgggcccggaagacggcatcattcgcggcaatgacggtgcggtctacaaggccggttgggatgccttgatcgccagcggcgcgcggatcatcaacaacagttggggcatcggtatcaccgatcgcttcgacctcggcggacgcaatcccgcctacccgcatttcaccgtgcaggacgcgcaattgcagttcaacgagatccgtccgttgctcgggaccaaaccgggcggagcctacgacggcgccatcgcggcggcccgcagcggtatcgtgacgatcttcgcggccggcaacgactacaacctcaacaacccggacgccatcgccggcctgggctatttcgtcccggacatcgcgccgaactgggtcaccgtggcggcgttgcagaaaaacccggacctcaacagcccggatctctacaacatcagcaccttctcatcgcgctgcggctacaccgccagcttttgcgtgtccgcaccgggcagcaagatctacagctcgatcatcagcggtaccaacgccggcgacctgaccaccggctacaagaattacaacggcacctcgatggcggcgccgcatgtcgccggttccatggccgtgttgatggaacgcttcccgtacatgaccggcgcccaggtcgccagcgtgttgcgcaccacggccaccgacctcggtgcgccaggtgtcgattcgctgtacggctggggcatgatcaacctgcgcaaaggcatcgatggcccggcgatgtttgtcaccgagcaagacattcccgaggagttccgcatccagggtgcctacggttcgagccagtttgtcgcggatttgccggggatcggcgcgatcatcgacgcgggcaaaccgaccgagcgcgtgtgcaatgacgtgcactgcggcctcgacacgtggcgcaacgacatttccggccatggtggcctgaccaagcagggcatcggcacactggtgctgaccggcgccaacacctatgccggcccgaccctggtcaatcagggccgcctggcaatcaacggctcgctgctctcggcggtcaccgtcaacgacagcgggatcctcggcggtaatggccgcatcggcgcattgaccgcgaaaagcggtggcaccgtagcgccaggcaattccatcggcaccttgcaggtggcgggcgacgtcaccttcgaacctggctcgacctacgccgtggagttgtcgccgaccagcagcgatcggatcgtggcgggcggcaaagccgtgatcgacggcgctaccgtcagcctgtccctggaaaacagcccgaccttgctgaccaccagtgaagtgaaatccttgctcggcaaccaatacaccattctgcaagcggccggcgggatcgaagggcgtttcggcgcggtgataccggattacctgttcattggaggcacactcggctactcggccaatggcatccaactggcggtagagcgtaacgcagcgtccttcgccagcgtcggccaaaccccgaaccaacgcgctgtcgcagcggccgccgagcaactgggcgccggcaatcctctctatgaaaccttactgctttcgccgaccgctgccgtcgcgcaacaagctttccagcaactgtccggtgagattcacccggcgatcggcacgttgttgatcaacgacagccgttacctgcgcgatgccgtcggtgaacgcctgcgtgagcgtgatctgttcaacgctgcggcaccgaccgatgaccgtagcaacgcctgggtcaaagtcctcggcgcctggggcaagagcgatggcgggcatgacaacgccagttccaacagctccatcggcggcttgctggccggtgtcgacggtctgatcactgaaaatacgcggctgggtttcgtgactggttacagcgacagttcgttgagcatgggcgatggcacgcattcctcagcctccgtcgatagctaccacttgggcgcctatctgggccatgaaatcgatgcgctgcgtctgagcgtcggcggtgcatacagctggcatcgcatcgacgtgaagcgtgacctgcaattgggcgacgtcagcggcaaacagaaatccaaacgcgatgcgacaaccgcacaactgtttaccgaagcggcgtatcgcctggacctgcagccgctggcgctggaaccgttcgccaacctggcttacgttcacctcaacagcgacagcttcaccgagaagggtgatgccgcagcgctcaagggcggtgaagacaaccgcgacgccgtgctctcgaccctcggcctgcgggcgagtaaagcgattgccctgtcggaccaacagcagctggaactgtccggcacgctgggctggcagcacaacctgagcaacacccgttccgaagatcacctggccttcgccaacggcaacaccgcgttcagcgtgcagagcgtttccctggaccgtaacgctgccgtcatcggtgcgcgggccggtttggctgtggcgcaggacgttcgtttgagcctggattacaacggactgctcggctcccgcgagaaagaccacggtgtgggtctgacgctcgactggcagttctga

SEQ ID NO: 84 - protein, 1015 aa, Unknown
  Obtained from an environmental sample.
  SIGNAL (1)...(22)
MNNKHNNLAMLCALATLGTAHAAPYVENGRAGDPNSWRSTEFNADWGLGAVNAQEAYAAGYTGKGVKLGIFDQPVYAAHPEFSGPNKVITLVTSGIREYTDPYIPVKAGDAFRYDGSPSIGSDGKLGAHGTHVGGIAAGSRDGGPMHGVAFGAQIISADNGDPGPEDGIIRGNDGAVYKAGWDALIASGARIINNSWGIGITDRFDLGGRNPAYPHFTVQDAQLQFNEIRPLLGTKPGGAYDGAIAAARSGIVTIFAAGNDYNLNNPDAIAGLGYFVPDIAPNWVTVAALQKNPDLNSPDLYNISTFSSRCGYTASFCVSAPGSKIYSSIISGTNAGDLTTGYKNYNGTSMAAPHVAGSMAVLMERFPYMTGAQVASVLRTTATDLGAPGVDSLYGWGMINLRKGIDGPAMFVTEQDIPEEFRIQGAYGSSQFVADLPGIGAIIDAGKPTERVCNDVHCGLDTWRNDISGHGGLTKQGIGTLVLTGANTYAGPTLVNQGRLAINGSLLSAVTVNDSGILGGNGRIGALTAKSGGTVAPGNSIGTLQVAGDVTFEPGSTYAVELSPTSSDRIVAGGKAVIDGATVSLSLENSPTLLTTSEVKSLLGNQYTILQAAGGIEGRFGAVIPDYLFIGGTLGYSANGIQLAVERNAASFASVGQTPNQRAVAAAAEQLGAGNPLYETLLLSPTAAVAQQAFQQLSGEIHPAIGTLLINDSRYLRDAVGERLRERDLFNAAAPTDDRSNAWVKVLGAWGKSDGGHDNASSNSSIGGLLAGVDGLITENTRLGFVTGYSDSSLSMGDGTHSSASVDSYHLGAYLGHEIDALRLSVGGAYSWHRIDVKRDLQLGDVSGKQKSKRDATTAQLFTEAAYRLDLQPLALEPFANLAYVHLNSDSFTEKGDAAALKGGEDNRDAVLSTLGLRASKAIALSDQQQLELSGTLGWQHNLSNTRSEDHLAFANGNTAFSVQSVSLDRNAAVIGARAGLAVAQDVRLSLDYNGLLGSREKDHGVGLTLDWQF

SEQ ID NO: 85 - DNA, 2166 bp, Unknown
  Obtained from an environmental sample.
atgcgtttcactttaaccacgttggccgtatcggtcgcgctagtcgccggatgcagcaatcaaggattaccaaccatgaaccattactcccaatcgcaactcgttgctcaacaaacccaagcacccgttgctaaaaaagtccgtcatgcaatgaatattcatggtgatacacgaatcgataattactactggatgcgtgatgatgagcgccaagacccagaaatcttgcaacaccttgagcaagagaatcaatacgcagaaaccgttttaaaacacaccgaagcactgcaagaacagctgtttgaagagatcaaaggtcgtattgcgaaagatgacaattcggttccagttcgtaaaggcagttactactactcaaatgaagtgacgggcgataacgaatacgaagtacacctgcgtgcaaaagactttgccggtacagacaagcaagtcattctagatgttaacgagctggcaaaagagcatgagttctttagcattggcggcctatacgtgagcccaaatgaaaacatgctggcttacggtgaagatacgctgagccgccgtatttacaccatcaagatcaaagacctcacaacgggcgaatatctaaaagatgaaattgaaggcgcctcaagcgcaatcgcatggcaaaacgataaccaagccttctactacatcaagaaagacccgcaaacactgttgggttatcaagtttaccgccatgtcttgggcacacctcaaacaagcgatgagctaatctacgaagaaaccgatagcgcttactacaccttcttgagtaagagtaaagacggtgagcaagtttacatttggcactcaagcacagagacaagtggcgtatctgtgattgatgctaacaacccgaacgccaaagccgaagctttctaccctagagaaactggcattgagtacagcatcgccaaactgggagattggtactacgtctacactaactaccaagctgtcaactttcgtttgatgaaagtgaaagcagaagagatgcatgaccgctctaaatgggtcgatgtcattcctgccgacgacaacacccagctggtcgatttcgacttgttcgacgaccaccttgtttacgagcaacgcacaaacggcttatccaccgtcaaggttcgccaactatcgacgggcaaagaattcccacttgaatttaatgacaccgcgtttgcggcttacctgacaggcaactacgaattagataactcaaaagttcgtatctactacagcagcctgactacaccgggtacttactacgatttcgacctgaatacaggtgaatcagaaatcatgaaacaaacaccattactgggtgatttggatgctgataactaccattcaaagcaaattatggtgaccgctcgtgatggtaaccaattaccagtctcattggtttaccgcaaagacctatttaaaaaaaacggcaccaatccaatctaccaatacggctacggctcttacggttcaactattgaaccaacgttccgttcaacccgcctgagcctacttgatcgcggcttcgtgtacgccatcgctcatattcgcggttcagaaatgctagggcgtccttggtatgaagatggcaaaaagctgaccaaacaaaacaccttcaatgattttatcgatgtaaccaaaggactggttgaagaaggctacggggccaaagataaagtctttgctgttggaggctcagcaggtggcctgctaatgggtgcaatcatcaaccaagcaccagagctttaccgtggtattggtgcgcatgttccttttgtcgacgttgtaacaaccatgctggatgagtcgattcctcttaccaccaacgagtacgatgaatggggtaacccaaatgacaaaacctactacgactacatggtgagctactcaccgtacgataatgtgaaaactcaaaactacccgaacatgttggtgacaacgggtttgcatgattcacaggtgcaatactttgagccaatgaagtgggtagccaaacttcgtgaaatgaagactgatgataatgtcttgctgttcaaaaccgatatggaagcaggccatggcggcgcttctggtcgattcaaacgattaaaagaagacgcacttgagtacgctttcttcctagatctgttggagaccaaataa

SEQ ID NO: 86 - protein, 721 aa, Unknown
  Obtained from an environmental sample.
  SIGNAL (1)...(20)
MRFTLTTLAVSVALVAGCSNQGLPTMNHYSQSQLVAQQTQAPVAKKVRHAMNIHGDTRIDNYYWMRDDERQDPEILQHLEQENQYAETVLKHTEALQEQLFEEIKGRIAKDDNSVPVRKGSYYYSNEVTGDNEYEVHLRAKDFAGTDKQVILDVNELAKEHEFFSIGGLYVSPNENMLAYGEDTLSRRIYTIKIKDLTTGEYLKDEIEGASSAIAWQNDNQAFYYIKKDPQTLLGYQVYRHVLGTPQTSDELIYEETDSAYYTFLSKSKDGEQVYIWHSSTETSGVSVIDANNPNAKAEAFYPRETGIEYSIAKLGDWYYVYTNYQAVNFRLMKVKAEEMHDRSKWVDVIPADDNTQLVDFDLFDDHLVYEQRTNGLSTVKVRQLSTGKEFPLEFNDTAFAAYLTGNYELDNSKVRIYYSSLTTPGTYYDFDLNTGESEIMKQTPLLGDLDADNYHSKQIMVTARDGNQLPVSLVYRKDLFKKNGTNPIYQYGYGSYGSTIEPTFRSTRLSLLDRGFVYAIAHIRGSEMLGRPWYEDGKKLTKQNTFNDFIDVTKGLVEEGYGAKDKVFAVGGSAGGLLMGAIINQAPELYRGIGAHVPFVDVVTTMLDESIPLTTNEYDEWGNPNDKTYYDYMVSYSPYDNVKTQNYPNMLVTTGLHDSQVQYFEPMKWVAKLREMKTDDNVLLFKTDMEAGHGGASGRFKRLKEDALEYAFFLDLLETK

SEQ ID NO: 87 - DNA, 1848 bp, Unknown
  Obtained from an environmental sample.
atgaagtctaagcaatcgatgtatccggcagtgttgaaactgtgcgccgcggccgttctcggcctgggagccggcgtggcggtcgcgggcgtgtccgcgaccgcacagggcacacccgtcgcgcagggtgccgttgttgcagacaagaccgaccgcatcatcgtcaagtacaaggacgaacaggcgccggtggccgtgaagggcggttcgatcgccgccatggccaaggccacggccgagccgatgtcgacggcgcgcaaggccaagctggaccgcgccggccagcagttcggcttcctgatgaaggaatcgcaccgcatcgccaccggcgcccgcgtcgtcaagctggaccgcaaggtctcgctgcaggaagccgcgcaagtggcggccgacctggccgcgcgcgacccggacgtcgaatacgccgaaccggaccgcctgctgcatcccctgatgacgccgaacgattcgatgtacagccagcagtgggacttcttcgaagccaccggcggcatgaacatcccggcggcctgggacaagtcgaccggctccggcatccgcgtggccgtgatcgataccggctaccgtccgcacgccgacctgtcgggccagatcctggccggctatgacttcatttccgacgccaccatcggcaacgacggcaacggccgcgacagcgacgccagcgacccgggcgactggaccgcggccggcgaatgcggcgccggcgagccggcgtccaactcgagctggcacggcacccacgtggccggcaccatcgccgcgctgaccaacaacggcagcggcgtggccggcatcgcctacggcgccaagatcgtgccggtacgcgtgctcggcaaatgcggcggctacacctcggacatcgccgacggcatcatctgggcttccggcggcaccgtctcgggcgtgcccaacatcgcggcgcgcgcgcaggtgatcaacatgtcgctgggcggcggcggcgcctgcggcaccacgacccagaacgcgatcaacagcgcccgctcgcgcggcaccgtggtcgtggtcgcggccggcaacgagtcgcagaacgccagcaacagcaacccggccaactgctcgggcgtgatcacggtggcggcgacgaaccgttccggcggacgcgcatcctactcgaactacggcaccgtggtcgacgtggcggcgccgggcggcgacagcggcgcggccatcctgtcgacgctgaacgccggcaccaaggcaccgggcgccgacagctatgccggctacatgggcacctcgatggccaccccgcacgtggccggcgtggtcgcgctgatgctggccaagaacgcgtcgatgaccccggaccaggtcgaagccgcgctgaagtcgaccgcgcgcgccttcccggcctcgtgcagcggctgcggcgccggcatcgtgaacgcctcggccgcggtcgatgcggccatcggcggcggcggcaccacgaccggcccgacggtgtcggaaaccgagtcgaacaacacgatcagcaccgccaacagcgtgacgaccacgggtaccacggtcaacggcaccatggccagcagcacggacaccgattacttcgtggtccaggtcccggccggcaagacgctgagcgccaccctgaccccgggttcgagcgccgactacgacctgtatatctacaacagcgcgggcacccagctggcgaccagccagaacggcaccggcgcggtcgacagcgccagctcggccaactccaccacggccgcctcggcacgctacgtgcgcgtggtgtactacagcggcggcaccggctcgaccaacggcaagtacacgctgaaactgtcgtggtaa

SEQ ID NO: 88 - protein, 615 aa, Unknown
  Obtained from an environmental sample.
  SIGNAL (1)...(35)
MKSKQSMYPAVLKLCAAAVLGLGAGVAVAGVSATAQGTPVAQGAVVADKTDRIIVKYKDEQAPVAVKGGSIAAMAKATAEPMSTARKAKLDRAGQQFGFLMKESHRIATGARVVKLDRKVSLQEAAQVAADLAARDPDVEYAEPDRLLHPLMTPNDSMYSQQWDFFEATGGMNIPAAWDKSTGSGIRVAVIDTGYRPHADLSGQILAGYDFISDATIGNDGNGRDSDASDPGDWTAAGECGAGEPASNSSWHGTHVAGTIAALTNNGSGVAGIAYGAKIVPVRVLGKCGGYTSDIADGIIWASGGTVSGVPNIAARAQVINMSLGGGGACGTTTQNAINSARSRGTVVVVAAGNESQNASNSNPANCSGVITVAATNRSGGRASYSNYGTVVDVAAPGGDSGAAILSTLNAGTKAPGADSYAGYMGTSMATPHVAGVVALMLAKNASMTPDQVEAALKSTARAFPASCSGCGAGIVNASAAVDAAIGGGGTTTGPTVSETESNNTISTANSVTTTGTTVNGTMASSTDTDYFVVQVPAGKTLSATLTPGSSADYDLYIYNSAGTQLATSQNGTGAVDSASSANSTTAASARYVRVVYYSGGTGSTNGKYTLKLSW

SEQ ID NO: 89 - DNA, 1791 bp, Unknown
  Obtained from an environmental sample.
atgcagaaacacaagctaacctggaaggcgctgcgatactgcctgctgatcgccctggccctggcccaaaccggctttggggcgccagcagcggcggcacagtccggcgaggccatgccgccggcagccagcggggctgcggacgacctgccgaccgatcagattattattctgtacgaagaaattgcctccggcgcgccggccatgcagcagctgagctttgccgccggggccgggctgacccaggtgcgcgaattgtcgggcggtggggcggtcatgcagctgccagacccgctgcccgccgaagaggtcgaggttcttgcgcggcggctgatgaacctgcccgaggtggcgtatgccgagcccgatcacatcaacctgccggccgtgctgcccaatgactcgttcttctccgcgtaccaatggagccttaccgcgcccaagaacaatatctacggcatcgacgcccccgccgcctgggaaatttcgaccggctcgcctgacatagtggtggccgtgctcgatacgggcatcctcaaccacgccgatttgaacgggcgaaccgtcgccggctatgatttcatcacaaatgcctggatggccaacgacggcgacgggcgcgaccccaaccccacggaccccggcgactggctgaccaccaatgacattgcaacccattgttattatgcgccggtgatggacagctcgtggcacggcacgcatgtggcgggcataatcggcgcggccagcaataacagtcttggcatatccggcatcaactggacgtcgaaaatcctgccggtgcgcgtgctgggcaagtgcggcgggtacgattcagacatcatcgacgccatccgctggtcggccggcctgccggtacccggcgcgccagccaaccccaacccggccaaagtaatcaacctcagcctgggcggcccaaatacgtgcagctcggtcatgcagtcggccatcaatgacgcgtacgagcagggggtcacggtggtggtcgccgccggcaacagcagcatggatgccgccggcttttcgccggcctcctgcagcaatgtgatcgccgtgggcgcgaccggcccgactggctcgcgcgcgtggtacagcaactacggcgctaccgtggccatctccgcgccgggcggcgacggcagcagcgctatctattcgctgcacaattccggcaagaccacgccggtagccgattcctaccagtacatgatgggcaccagccaggccgcgccgcacgtcagcggggtggtttcgctgctctattcgctcaaccccgcgctgacccccgaccaggcgcgcgccgttctgaccagcaccgccacggccttcccggcgggcagcagctgcgccaccggtctgtgcggggcgggcatcctcaatgccgggcaggccgtgcaggccatgaccaccccgcccggcaccttccagaagatcgcgccgctgaacaatgccgccggcctgccggtcaacagcgtggtcctggagtggagccccagcagcggggcggcctcgtacgagtactgctactacgcccccgcgcttcaggcagcctgcgccagctggatcagcgccggggcgagcaccaaagccacgctcaccaatctgctccccgccgtgacctactcctggcaggtgcgggcggtaaatgccgcaatcaccgccaccgacgccgatttcgtcgccaacagcggaacctggtggacgttctcgaccgaggcggtcagcttcaacgtaacctacaacgtgtttatgccgtcggtcgtgcgctaa

SEQ ID NO: 90 - protein, 596 aa, Unknown
  Obtained from an environmental sample.
  SIGNAL (1)...(32)
MQKHKLTWKALRYCLLIALALAQTGFGAPAAAAQSGEAMPPAASGAADDLPTDQIIILYEEIASGAPAMQQLSFAAGAGLTQVRELSGGGAVMQLPDPLPAEEVEVLARRLMNLPEVAYAEPDHINLPAVLPNDSFFSAYQWSLTAPKNNIYGIDAPAAWEISTGSPDIVVAVLDTGILNHADLNGRTVAGYDFITNAWMANDGDGRDPNPTDPGDWLTTNDIATHCYYAPVMDSSWHGTHVAGIIGAASNNSLGISGINWTSKILPVRVLGKCGGYDSDIIDAIRWSAGLPVPGAPANPNPAKVINLSLGGPNTCSSVMQSAINDAYEQGVTVVVAAGNSSMDAAGFSPASCSNVIAVGATGPTGSRAWYSNYGATVAISAPGGDGSSAIYSLHNSGKTTPVADSYQYMMGTSQAAPHVSGVVSLLYSLNPALTPDQARAVLTSTATAFPAGSSCATGLCGAGILNAGQAVQAMTTPPGTFQKIAPLNNAAGLPVNSVVLEWSPSSGAASYEYCYYAPALQAACASWISAGASTKATLTNLLPAVTYSWQVRAVNAAITATDADFVANSGTWWTFSTEAVSFNVTYNVFMPSVVR

SEQ ID NO: 91 - DNA, 1425 bp, Unknown
  Obtained from an environmental sample.
atgggttcttctttattaaaaaaagcagtaggattatctaatgtttctgacttattagataaaagtggaattttttataatttctcagctaaaactctaccttcttttgattatgatactgcaggaaaacatattgcacgggaaaattccacatggaatgggaagtatgttattgggcaagcggcagaagtgacatattcattcccaacttgggctggtaaaaagtttaatgattttggtgataaaaatccctatggatttaattcagcgcaaaaagatcatgcaagacaatctttagatgcatggtctgatattgcaaatatcaaatttaccgaagtggcaccaaatgtaaaatcagatattacttttggtaatattactgatccatacggcaacttccaagcttatgcaactttgccaaatacctatagttatggccgtgatctttcagggcaagcttggtttagtgattattatgatgcaaaaaatacaacacctgaattaggtaattatggtcgtttaactattatccatgaaattggtcatgcgcttggtttaatgcaccctggcgattacaacgcagggcaaaacgtacctggatatttaaaatctgactatgctgaagatagtcgccaatatactgttatgagttattgggaagaatatgaaacaggtgcgcacttccaaggtgcttatgcgggcgctcctttacttcatgatatttcagcaatgcaatatctttatggcgcaaataccacaaccagaacaggtgatgatgtttatggttttaactcaaacactggtattaattattacacggcaacaagtagcagtgataaattaatcttctcagtttgggacagtgcgggtaacgatacttttgacttctcaggatattatcaagatcaagttattgacttacgtgagggtcatttctctgatgttggcggactacagaaaaacgtttctattgcacaaggcgttacaatagaaaatgcaatcggtggctctggtaatgatactatctatggaaatgatgctgataatattctcatcggtggtggcggtaacaacatactgtatggtggcggtggtcaagatatattatggggtggtacaggtagcaatacctttgtttataaaaagatcaccgactctttaacctctgctgctgacaagataatggacttcaaatcaggtattgataagattaatttatcagaattaatcgacgatacctttggccataaattccttaactttgttgataattttacaggtcgctcgggtgaagcaaccattaaatatgatcaatcaacaaactcaagtgaacttgctattaatgcttatggatatggatatagccctgatttcaaaattgacattgtaggatttgttaattacgaaactgacattattgtttaa

SEQ ID NO: 92 - protein, 474 aa, Unknown
  Obtained from an environmental sample.
MGSSLLKKAVGLSNVSDLLDKSGIFYNFSAKTLPSFDYDTAGKHIARENSTWNGKYVIGQAAEVTYSFPTWAGKKFNDFGDKNPYGFNSAQKDHARQSLDAWSDIANIKFTEVAPNVKSDITFGNITDPYGNFQAYATLPNTYSYGRDLSGQAWFSDYYDAKNTTPELGNYGRLTIIHEIGHALGLMHPGDYNAGQNVPGYLKSDYAEDSRQYTVMSYWEEYETGAHFQGAYAGAPLLHDISAMQYLYGANTTTRTGDDVYGFNSNTGINYYTATSSSDKLIFSVWDSAGNDTFDFSGYYQDQVIDLREGHFSDVGGLQKNVSIAQGVTIENAIGGSGNDTIYGNDADNILIGGGGNNILYGGGGQDILWGGTGSNTFVYKKITDSLTSAADKIMDFKSGIDKINLSELIDDTFGHKFLNFVDNFTGRSGEATIKYDQSTNSSELAINAYGYGYSPDFKIDIVGFVNYETDIIV

SEQ ID NO: 93 - DNA, 984 bp, Unknown
  Obtained from an environmental sample.
atgggacttggcttttcgactgcattgcagcaacgcgcgcaccacccgatagccggcatgatcctggccgtggccgtttcaatgattccgggttccggtgttctggcgcaggataaggctcctttcacccccgatcagggcaggctcttcttgaacaacgccgccgagaaggcgagggaatcgcagaagacgaccaccaagacgtttgaggaattcaagaaatcggtcaccaaggagccgttccagtacggcaaatacattgtcaatggcgacacccccattgccaacgacaaggatcttgaggagttctacaagcagaacgtggagaccgcggggcttgtcgccgcagagtttgccatcatgaacaagctcggcatcgacatcatctggaaggacgccgacaagaagaatctcacatactgcgtgagcaacgccccggcggagtccggtggattcggaaatcgctacaacaccgtcgtgagcgccatggccgacgcgaccaaggcatgggaagcagttgccgacatcaagtttattcacgtgactgccgaggattcgaactgcacgccgaccaacgagagcgtcaaattcgacgtcaggccggtcaatctcaacgcatatctggcgcgggcatttttccccgacgatgtgcgcaccgcgcgtaacgtcctcatcgacaactcgtcgtttgagcttcccgccggaggaaagctctcgttgatcggcattctccgacatgaactcggacacacgattggtgcgcggcatgagcatacgcggccccagtcgggaacctgctttgaggacaaggattggaggggcgtgaccgactacgatgcgttgtcggtcatgcactatccgcagtgcaacggaaagggcgattggtcgttgaccttgacggtgcaggacaagaacggcgtcgcgtgcgtgtacaaggcggccccgggattcgtgatcgacaccaagatctgcaagccgaagtag

SEQ ID NO: 94 - protein, 327 aa, Unknown
  Obtained from an environmental sample.
  SIGNAL (1)...(36)
MGLGFSTALQQRAHHPIAGMILAVAVSMIPGSGVLAQDKAPFTPDQGRLFLNNAAEKARESQKTTTKTFEEFKKSVTKEPFQYGKYIVNGDTPIANDKDLEEFYKQNVETAGLVAAEFAIMNKLGIDIIWKDADKKNLTYCVSNAPAESGGFGNRYNTVVSAMADATKAWEAVADIKFIHVTAEDSNCTPTNESVKFDVRPVNLNAYLARAFFPDDVRTARNVLIDNSSFELPAGGKLSLIGILRHELGHTIGARHEHTRPQSGTCFEDKDWRGVTDYDALSVMHYPQCNGKGDWSLTLTVQDKNGVACVYKAAPGFVIDTKICKPK

SEQ ID NO: 95 - DNA, 1806 bp, Unknown
  Obtained from an environmental sample.
atgaaaatcaataaattaagcaaaatttctttcgcaaccttcatggctttaggctgcaccactgtggcagcagcagatcgggttattattcaggtcgacaatgccaacaaaggtatagtcaccgcattaacaaaacagctgggtggcgacgtaaaagtagatgcagatggttttatcgctgctcagttcaatggtaaatctgttgatgaaatcaaaggtattctgaaaaaccctcatatcaaactgattgaagaagatttagtacgtaaaccaatggcgttatttaatgacgacgctggtgatccaatgcaacaacaaatcacaccttatgctgtgtatcaatctcaggccaatcaggtgcaatttaaccctggcgcaggtatcaaagtctgtgtcattgactcaggtttagaccagtctaaccctgattttaactggggcagcatcacgggcgacaacgattcaggcacaggcaactggaatgtcaacggtggcccacacggcactcacgtcgccggtaccataggtgcggcagacaacggttttggtgtgataggtatggcccctggcgtagctatgcatatcatcaaagtatttaacgctgaaggttggggttattcgtcagatctggcttatgccgcacaaaaatgtaaaaacgcaggctcagacattatcagcatgagcttaggcggtggtggtgccaataccactgaatccaacgcttttaaaacctttaccgacgctggtggtttagttatagccgcagcaggtaacgacggcaacaatgtgcgctcttacccggctggttacccttctgtcatgatgataggagccaacgacaataacaacaatatcgcagacttctcccaattcccaagctgtacagccaacggcaaaacagatgagactatttgtgtggaagccacagctggtggtgtagacaccttgtccacctaccctgccgatatggcaaccagcgccaccttgagtgccaacggtactccttatgccacctctgcgatggaaaatccgggttcagccagtgcagctacattctttatgggcacagcggaaactgtcaactcaggcgcagccggtaagatttgtatgattgaccgtggtgtgatctctttccacgacaaagtgaaaaactgccaaaactctggtggtgtaggtgctgtcatcattaacaacacagctggcatgttgtacggcactttgggtgaaggttctgctaacactacatcaatccctgcagtaggtgcggcttttgaagacaggactgcgctgttggccgctactactgcatccatcaacatcggcaccagcgattatggtctgatgagcggaacttctatggcaacgccggctgtttcaggtattgcagctctggtgtggtcaaatcacccgggctgtactggtactcaaatccgtaatgcgttaaaagcgacggcaaaagacgcaggtgctgcgggcaaagatgtgtacttcggttatggtattgtgcaggccgctgctgcgcatcagtacctgacgaccaatggttgtggtggtggcactacaactccgggcatcagcctgactttacagggcgtatccagcaaaggtaaacgttatgtcgacctgacatgggccagtgcgaccaccagctcagttgatatttaccgcaacaacgtcaaagtactgaccacaaccaatgacggcgcacatcgtgatggcccgttaaaccgtggcagctatagttataaagtctgtgaagcggcaagcaccaccaagtgtagtgccagcacttctatcagtctgtaa

SEQ ID NO: 96 - protein, 601 aa, Unknown
  Obtained from an environmental sample.
  SIGNAL (1)...(24)
MKINKLSKISFATFMALGCTTVAAADRVIIQVDNANKGIVTALTKQLGGDVKVDADGFIAAQFNGKSVDEIKGILKNPHIKLIEEDLVRKPMALFNDDAGDPMQQQITPYAVYQSQANQVQFNPGAGIKVCVIDSGLDQSNPDFNWGSITGDNDSGTGNWNVNGGPHGTHVAGTIGAADNGFGVIGMAPGVAMHIIKVFNAEGWGYSSDLAYAAQKCKNAGSDIISMSLGGGGANTTESNAFKTFTDAGGLVIAAAGNDGNNVRSYPAGYPSVMMIGANDNNNNIADFSQFPSCTANGKTDETICVEATAGGVDTLSTYPADMATSATLSANGTPYATSAMENPGSASAATFFMGTAETVNSGAAGKICMIDRGVISFHDKVKNCQNSGGVGAVIINNTAGMLYGTLGEGSANTTSIPAVGAAFEDRTALLAATTASINIGTSDYGLMSGTSMATPAVSGIAALVWSNHPGCTGTQIRNALKATAKDAGAAGKDVYFGYGIVQAAAAHQYLTTNGCGGGTTTPGISLTLQGVSSKGKRYVDLTWASATTSSVDIYRNNVKVLTTTNDGAHRDGPLNRGSYSYKVCEAASTTKCSASTSISL

SEQ ID NO: 97 - DNA, 681 bp, Unknown
  Obtained from an environmental sample.
ttgatggacaacccggtcgtcgtcgattttccgctgcggggcgagtggaatgcgcccaacacgcccggcacgcgcatccccagccacggcacggatatgctcggccagcgctacgcttatgattttatcggcgtagcgccaggaggcagcagcctgaagttctaccgcatgagcccactgcgctatttgctgttcggcgcgcgcctggcggactgctacggctggggccagccgatctacgcggcggcggacggtacggtggcgcaggccggcgacggctggcccgagcgcaacccggtgcacctcgcccgggatctgttcatgctctttaagaacggcctgtcgatccgctcaaccgaggggctcgacctgcgcatcctgaccggcaattacgtcatcgtagagagcagcgcgggctatatgctctacgcccacgcgcagaacggctcggtgcgcgtcgcgccgggcgagaaggtgaccaccgggcagcacctggcgaatgtaggccattcgggcaattccaccgcgccccacctgcacttccatatcatggatcagctcgacccgtggaaagcgcagggcatcgcctgctgtttccgcgaatatgaggtctggcagaacggcggctggcagccggtgcgcaacggcatccccaccgccgccgaacgcatccggcggtag

SEQ ID NO: 98 - protein, 226 aa, Unknown
  Obtained from an environmental sample.
MMDNPVVVDFPLRGEWNAPNTPGTRIPSHGTDMLGQRYAYDFIGVAPGGSSLKFYRMSPLRYLLFGARLADCYGWGQPIYAAADGTVAQAGDGWPERNPVHLARDLFMLFKNGLSIRSTEGLDLRILTGNYVIVESSAGYMLYAHAQNGSVRVAPGEKVTTGQHLANVGHSGNSTAPHLHFHIMDQLDPWKAQGIACCFREYEVWQNGGWQPVRNGIPTAAERIRR

SEQ ID NO: 99 - DNA, 1944 bp, Unknown
  Obtained from an environmental sample.
atggcctttcttgctgcccgtccgaaggacgcgctattttcctcgcagtggcatctttcctcgttgcgttcggatgtttcgctgaatcttcgagacgtttggaccgactacaagggtgctgggattaggctagcggtccttgatgacggcttcgaccgccatcatgctgacctgcgtgcaaactacaacgtcaacatcgaccgtgattttgtcggccgtggtgactttgacgcgattcatgagcgcggcaactggcatggtactgctgtgatgggcgtggccggcgctgacgacaatggagttggggttacaggtgttgccacagacgtgaccctgatgggcctgcgtatcggctttggctctgccggcaatccggcgcagtacgcggcggctctcagcgagagcgcaaaagctgacgttgcaaacagttcatgggggtttggtggcttcttcattgacaattttgatagtcatcatttccgtgccgccgaaagcgctctgaagttttcggttgacaatggccgtggtggccttggtactgttcaagtttttgctgctggtaactcgcgagcgtcgggtgacgacgtgaacttccacaacttccagaattcaatctatacgatggcagtgggtgcgacggacaccgccggtcgggtagcttcattctcgacgccgggcgttgcgcttcatgtctctgcgccgggtgtgtcgattctgacaactgacgtctcgggccgtgacggctatagctctggcaatgaggcgtgggtgcaaggcacgtcctttgccgccccgtcggttgcaggcattgtctcactcatgctcgatgctaatgcccgtcttggatggcgagatgttcaagagatcttagcttattctgcgaaggagacgacagccgggatttccgatccattcttgatcacgaataaggcagacaactggaatggtggcggccttacccatagcaagaattatggcttcggtctggttgatgcccatgctgcggtccgccttgccgagacttggaccgagcagcagacttcgcacaacatgatgactgcatcttttggagctgcgccgcgggcaacgctgcgggacgcaggccgttgggagacgacgttcacgatcaaccgtgacatcaccattgaccgtgttgagcttgagattgatctcaagcacaactggattggagatctccgcataggtcttgtgtcagccgaaggcacaacgagttggttggtcgatcgtccgggcgtggcgcctggcgcggcggggaacggttcggggctaaaaaatatttggttcgacttcacgaccagtcagttctggggcgaggaagcgcgtggtacctggaagctggtcatcgaggacgtcaagcgtggcaatattggtcggcttgactggttccaagtcaacatctttggcgatcgcccgagcaacgatgactcttacatctacaccaacgagtttgcccgcctcggcgctcaatccggtcgtacggtgatcaacgacgcccaagggcgtgatgccatcaacgcctcagcggtaaccagcgatagcgttcttgatcttctccacggctcgatcattgccggccggcaggtttcttacggggctggcaccatcatcgagcgggcttttgctggtgacggcaacgaccaagtccgtggcaacaccatggataaccttctctggggcggtcgcggcaatgatgtccttgagggtcgcggtggttccgatatcttcgcctttggcgtacgttcgggacgcgatataattctagactttgacgcgaacgaccgaattctcctaacggacggggtgagtgtccgcagtctttcgggcagcgtcgccacgctctccgacggtgctaccattactgcagctaacggttggcagtggcagatgtccaatttctaccaaggcgatttgctctttgcttga

SEQ ID NO: 100 - protein, 647 aa, Unknown
  Obtained from an environmental sample.
MAFLAARPKDALFSSQWHLSSLRSDVSLNLRDVWTDYKGAGIRLAVLDDGFDRHHADLRANYNVNIDRDFVGRGDFDAIHERGNWHGTAVMGVAGADDNGVGVTGVATDVTLMGLRIGFGSAGNPAQYAAALSESAKADVANSSWGFGGFFIDNFDSHHFRAAESALKFSVDNGRGGLGTVQVFAAGNSRASGDDVNFHNFQNSIYTMAVGATDTAGRVASFSTPGVALHVSAPGVSILTTDVSGRDGYSSGNEAWVQGTSFAAPSVAGIVSLMLDANARLGWRDVQEILAYSAKETTAGISDPFLITNKADNWNGGGLTHSKNYGFGLVDAHAAVRLAETWTEQQTSHNMMTASFGAAPRATLRDAGRWETTFTINRDITIDRVELEIDLKHNWIGDLRIGLVSAEGTTSWLVDRPGVAPGAAGNGSGLKNIWFDFTTSQFWGEEARGTWKLVIEDVKRGNIGRLDWFQVNIFGDRPSNDDSYIYTNEFARLGAQSGRTVINDAQGRDAINASAVTSDSVLDLLHGSIIAGRQVSYGAGTIIERAFAGDGNDQVRGNTMDNLLWGGRGNDVLEGRGGSDIFAFGVRSGRDIILDFDANDRILLTDGVSVRSLSGSVATLSDGATITAANGWQWQMSNFYQGDLLFA

SEQ ID NO: 101 - DNA, 1125 bp, Unknown
  Obtained from an environmental sample.
gtgctgagaaaaaccttgttcgtcgtcgttgcggcgctgttggcctcggctcaacccgtcgcagcgcaacgcatggagaacggaaacgtacggccggtgaacgacggcatagtgcaggaagtcagcaaggtgctgcagccgctaagcggacagccgcaatcggccaagatgcacgtcgacagcgcgggggcgaagagcattcgcgtcaggatcggcgttgccagcaatgcggcgccacgctcggattacactgtcgccgtcagggatcgaaacggcgggctggtggcgcgatacccggctgcggagcttcgcgccaagccggtctggagtcctcctgtcccgggcgcctcggtcgaggtcgaggtcgaggtcgaggcggcggcggcggatacggccggcattgcggtcgcggtgaccggcatcatcgggcagcgcacgccgggcgatccgatgctctcggtgctgggcgatacgttcgacctggaaccgatcgagtcgtttcggctggaaaagcccgagatattcaaggccgggctcgcggtagccaagctgatgctggtgcgtgacggcaagtctctggcgtgcacgggcttcatgatcgacgatgatcgcatgctgaccaacgagcattgcatcaatagccaggccatctgcgacagcgcagtcgcactgttcggatacgactcgaacgcgggtatgacgagcgacatggtgcgcgagcagtccgccgcctgtctggaattcaagagcatggacgagaagctcgacgtagcgatgattcggttggccaacagcccgggcaagcggtggggacgactgaagctcgctgtcgctgcgcccgacgaactgtcgatcgtgatccaccatcccaatggagatccgaagtatgtcacgcgagaggactgcttcgttggcaagctgcccgttgacgggcgcgccaaggacaccgatttcagccaccggtgcgacacgatgggaggtagctcgggctcgccggtcctgagccgaaggagcctggaagtcatcggcttgcatcaccttggcatcgacctcgctgatccggcttggcgggatcaaaatcgcgcggtgcgaatggagctcatccgcgccgcgctggggctttga

SEQ ID NO: 102 - protein, 374 aa, Unknown
  Obtained from an environmental sample.
  SIGNAL (1)...(22)
MLRKTLFVVVAALLASAQPVAAQRMENGNVRPVNDGIVQEVSKVLQPLSGQPQSAKMHVDSAGAKSIRVRIGVASNAAPRSDYTVAVRDRNGGLVARYPAAELRAKPVWSPPVPGASVEVEVEVEAAAADTAGIAVAVTGIIGQRTPGDPMLSVLGDTFDLEPIESFRLEKPEIFKAGLAVAKLMLVRDGKSLACTGFMIDDDRMLTNEHCINSQAICDSAVALFGYDSNAGMTSDMVREQSAACLEFKSMDEKLDVAMIRLANSPGKRWGRLKLAVAAPDELSIVIHHPNGDPKYVTREDCFVGKLPVDGRAKDTDFSHRCDTMGGSSGSPVLSRRSLEVIGLHHLGIDLADPAWRDQNRAVRMELIRAALGL

SEQ ID NO: 103 - DNA, 897 bp, Unknown
  Obtained from an environmental sample.
atgaaagagttaaaggtaatgcaaaaacatcaagaccagatttttaacctgccaaatatagtcggtgtaggtatcggctgcaaagtgaaagatggtattatttctcaagaacctgccattgtcgctttggttgttaagaaagtggacaaagcttatttgccggaagcaagcatggttccggctgaattggatggtgtagttaccgatgtcagagaagtaggggaaattaaacttcttgggcgtaccgataaacaacggccggcatgtcctggcatcagcattggtcattataaaattaccgccggtactttcggcgcaatggtttacgacaatcaaacaggtgatccgcttattctgtcaaataatcacgttctggccaatgtaactaatgggcgtgacggcagaagcgctattggtgatgcaatatatcaaccgggtagttatgacggaggtacgtcggcagataccattgcccacttgcaccggtttgtaccagtttattacggttcaagttcgaaagcgaatctggttgactgtgcagtagctaagccgataagcaatgatcttatcatcgacgagatcatggaaattggcaaagttgccggggtcgctcaggccgaggtaggtatgaatgtcaagaaaagcggccggactaccggactaacaacaggcactatcgacactgtgcataccacagtaaaggtgaacatgggcgtcggtacagctactttcaaagatcaaatcgtggccggtgcaatgtcccagggcggcgacagcgggtcattggtgcttaatgagcaaaacgaagcgataggattattgtttgccggttctgattataccactatattcaatgatatccagaatgttttgaacgcactgaaggtaaggttttag

SEQ ID NO: 104 - protein, 298 aa, Unknown
  Obtained from an environmental sample.
MKELKVMQKHQDQIFNLPNIVGVGIGCKVKDGIISQEPAIVALVVKKVDKAYLPEASMVPAELDGVVTDVREVGEIKLLGRTDKQRPACPGISIGHYKITAGTFGAMVYDNQTGDPLILSNNHVLANVTNGRDGRSAIGDAIYQPGSYDGGTSADTIAHLHRFVPVYYGSSSKANLVDCAVAKPISNDLIIDEIMEIGKVAGVAQAEVGMNVKKSGRTTGLTTGTIDTVHTTVKVNMGVGTATFKDQIVAGAMSQGGDSGSLVLNEQNEAIGLLFAGSDYTTIFNDIQNVLNALKVRF

SEQ ID NO: 105 - DNA, 2091 bp, Unknown
  Obtained from an environmental sample.
gtgagcgagctgcacgtctggcgccagtacacctggttgctggaacaagccaagacccagcaggagtgcgatgaaccccagacccgtcaggaaggggacaagaccatcagctatcgggtgtgccgtcagaccctgcccgccggcagcgaagtgcaggtggtcttgaaggacaccggctatcaatacccggtggggggcagcgaatggcagaccctgccggaaacaaccgagtggcaggagaaccgggtgctcaaccgccccatcgtgctggccagcaaggaagagcagctcgactgtcgccgtgccgacggccgcgcctgttccgagccggatctgccgggcaccgaactgctggacgccgaagcggccaagatagtgcaggatgccagtggccagcccgccccggtctggcaggagaactatggtcacgatgacaccaagctgctggccgtgtcgcgcggcatccagagcctgctggcggccaatcagccggcccatccggccatgaagctgctgctggaatacgtgcgtgcccacaactaccacaactacggcaagcacaaggaagacggcccggctgccgccgaggcgctggccgaggcattgaccgcgctgggcgcccatccgctgctcttcccggagcaggccagcgacgaggtaggcgccgtcatgggtgcctggagcatcgccctgcacggtcagttcaagagcccggcagtgcagagccgctttggcaccttgctcggcgagttcaaccagatgctggcctacagcacccgccatgccagcgagatcaacggtcagcacgcctgggcgaccggtctgttcgatctgctcaacttcctcgacttcgccagcgactacagcgatcccttcgccaacgacttccgccaacaggacggcgagctgcgcaagcagctgcacgccctcggcatgagcgagctcgcgttgtggaagggacgggatggcgccgatctgttcctgctcaacaacgtgctggatgcttacacccgcctctaccgggtcgcccgctatacccgcccggacgagctcgacggctaccgcaagctgctggatgactccgtcatcgcactggttcgccaccacgacctgatccccggtggccagcagagccaggatctgctggaagacatgtcgctgaccctctccacctactacctgacctacacggaccgcaccagcgaagcctgcatcagcggcgactttgccgggctctgcacccctgtccgggtagaggacgtgctgccgttcgagcacacctgctcgccgaccctgcgcctgcgggcccaggatctcaccatggatcaggccgaggggatctgccgtgaactgggtgccgaagagcagcagttccaccagcagatggagaccggctggcagccggtggcggacgatcacaacgaggcgctggaactggtggtcttcaactcctccgccgactggaaacgctacggcagtgccctgttcggcggcgtctccaccgacaacggcggcatctacctcgaaggggatccggctcgccccggcaaccaggcccgcttctttgcctacgaggcggagtggaagcgcccagcgttccaggtgtggaacctgcgccacgagtacgtgcactacctggacggccgcttcaaccagtacggcagcttcggccactacccgctcaaccgtaccacctggtggtcggaagggctggcggagttcgtcgcccacggtcagtgcttcgcccgcggtctggacaacgtcgccggccgtccggccagtgagcgtccggccctggccgacatcctgcacctggattacgacaagggcggcgagatggtctactcctggtcctacacggtgcaccgcttcctgaacgagaccggtcgcggcgccagctggctggccatggcccaggccctgcgcaacccggatcagcagcaggccatgagcgccttcgaagccgagctggaccagctgattgccaatgacagcgaggcctaccagcagtggctcggccgcgagctgctgccctggtgggaagccaacaaggactccgacgagtgcaaggccaacgactcctcccactga

SEQ ID NO: 106 - protein, 696 aa, Unknown
  Obtained from an environmental sample.
MSELHVWRQYTWLLEQAKTQQECDEPQTRQEGDKTISYRVCRQTLPAGSEVQVVLKDTGYQYPVGGSEWQTLPETTEWQENRVLNRPIVLASKEEQLDCRRADGRACSEPDLPGTELLDAEAAKIVQDASGQPAPVWQENYGHDDTKLLAVSRGIQSLLAANQPAHPAMKLLLEYVRAHNYHNYGKHKEDGPAAAEALAEALTALGAHPLLFPEQASDEVGAVMGAWSIALHGQFKSPAVQSRFGTLLGEFNQMLAYSTRHASEINGQHAWATGLFDLLNFLDFASDYSDPFANDFRQQDGELRKQLHALGMSELALWKGRDGADLFLLNNVLDAYTRLYRVARYTRPDELDGYRKLLDDSVIALVRHHDLIPGGQQSQDLLEDMSLTLSTYYLTYTDRTSEACISGDFAGLCTPVRVEDVLPFEHTCSPTLRLRAQDLTMDQAEGICRELGAEEQQFHQQMETGWQPVADDHNEALELVVFNSSADWKRYGSALFGGVSTDNGGIYLEGDPARPGNQARFFAYEAEWKRPAFQVWNLRHEYVHYLDGRFNQYGSFGHYPLNRTTWWSEGLAEFVAHGQCFARGLDNVAGRPASERPALADILHLDYDKGGEMVYSWSYTVHRFLNETGRGASWLAMAQALRNPDQQQAMSAFEAELDQLIANDSEAYQQWLGRELLPWWEANKDSDECKANDSSH

SEQ ID NO: 107 - DNA, 1116 bp, Unknown
  Obtained from an environmental sample.
atggctacatatatcgttacattagaagagggtcaaacaagagattgcctactaggttgtggcaaagtaggtaagccgcaatctgtacctgaatgcgttattgttgacaccctgcttactaagcaaacactagagggtatagatggcgttgtcagtgtaatagaggatcatcctgtgcagcctgaagaagcacgtcctactaataataactggttcctagaccgtatccacaaccaacagtcacgcagcaacacaacatacataccaacccgttcgggcaagggggtatgtatctatatcgtagatgatggtatgagagaatcacacagagatttctcaggacgtgtagcacaaacgattagaaatgtggacggtgtgtcaagggcacatggtactttggttgcaagttgtgcagcagggtctttatttggggcagcctttgaagcagaaatctatatggctgaaacattgtggacgtatgcagatacaattaaagctatggatgcttgtattgaccactatatccaaaatggacgtaaaccttccgtgttgaatttatcattcacatcaatgtcctccgcaggatatagagtagttatagacagagcttttagtgagggtatgactgttgtagcagcagcaggcaaccataacgacgattccctaaaaagattccctgcaaatcttgataacgtaatatcagtaggatgcttgactaaagatatggtaagagcttcttacagtaactacggagaactggtggatatatgggcacctggacacgatggaagagcggcgtcagccgtagataacaactcagcgagaatggccacaggcacttcatccgctgcacctgttatagctggtgtctgtgcaatgattcttgaagggaaccctaacctgacgaacgtagaggttcgtaaagaacttatgacaaatggttcattaccctttgcactaggtcgagttggatacgctcaagttacaaatacagcacctcttcccgaaccagaaccttgccctgaaccagagcctattgatacgtcagcaatagaacaagcattagcagattttaatgctgcaatgcaaaccttcatctctagtttgaataagtga

SEQ ID NO: 108 - protein, 371 aa, Unknown
  Obtained from an environmental sample.
MATYIVTLEEGQTRDCLLGCGKVGKPQSVPECVIVDTLLTKQTLEGIDGVVSVIEDHPVQPEEARPTNNNWFLDRIHNQQSRSNTTYIPTRSGKGVCIYIVDDGMRESHRDFSGRVAQTIRNVDGVSRAHGTLVASCAAGSLFGAAFEAEIYMAETLWTYADTIKAMDACIDHYIQNGRKPSVLNLSFTSMSSAGYRVVIDRAFSEGMTVVAAAGNHNDDSLKRFPANLDNVISVGCLTKDMVRASYSNYGELVDIWAPGHDGRAASAVDNNSARMATGTSSAAPVIAGVCAMILEGNPNLTNVEVRKELMTNGSLPFALGRVGYAQVTNTAPLPEPEPCPEPEPIDTSAIEQALADFNAAMQTFISSLNK

SEQ ID NO: 109 - DNA, 1215 bp, Unknown
  Obtained from an environmental sample.
atgaagtacattgtcattctaaagaaaggttacaatagagattcacttacagactattgcacaaaagtaggcaagccgtgtgagctacacaatctcgttatcattaacactgacgagtgtacggcaaagattattgctgacttagattgtgtggaatctattgagaaagattctgtatgtacatctgatgaggaattttacaagtcatctcgtactactgataattgggcattgacacgattcaattttacagaacctcaacgagagtatcctgagagttaccgttacaatcgcacaggcaaaggtgttggcatctacgttattgacagtggtgtacgtactactcatcaagagttagtaggacgtgtagaaactatctacagtacccttgaaggtaagcattttgacagtgataatgagctaaacattaaccgtagtcatggtacagccgtagcgtcagcagcagcagggaagaagctaggtattgcaagtgaagctactgtctacaacttattcgtagatttttctatgtcagacattatcaaagcgtttgatactgtattgcaccattacaaaaagtctaagagtgctgctgtacttgtgacatcattctcaactttgtcactagcaatgaaacctatctcagacgcactctaccaagcaggtctcgttcatgtatctagtgcaggtaatcagtctacagatactccaagataccctgctgcattccctcagactatctctgtaggtgctactgacaagcaggacaataaagcatcattcagtaactttggcaataccgtagacgtatatgcacccggagtgaatgtgaaggtagcggatcatgcaagagatgttcgtactcgtattgcaagaggaacctcattctctgcaccttatgttgctggtatcattgcactcatgctagaaggctcagacaagcctcgtaagagtgagcatgtcgataccatacgacaatccttcctagacaatgctgcaagtgcctctaaggcagataagcgtgtgccacatacacgttttgacattgaaccattcaagtttcctaaaccttctcctgtagaaaaaattgtacaaaaggtgtctgacaataaggaatcgtcaactatttcagacaaaggttctaagaagaattacgtcaaagaaattgtagcaggtgttatcctagtagctactatagctgcaattcttctgtaa

SEQ ID NO: 110 - protein, 404 aa, Unknown
  Obtained from an environmental sample.
MKYIVILKKGYNRDSLTDYCTKVGKPCELHNLVIINTDECTAKIIADLDCVESIEKDSVCTSDEEFYKSSRTTDNWALTRFNFTEPQREYPESYRYNRTGKGVGIYVIDSGVRTTHQELVGRVETIYSTLEGKHFDSDNELNINRSHGTAVASAAAGKKLGIASEATVYNLFVDFSMSDIIKAFDTVLHHYKKSKSAAVLVTSFSTLSLAMKPISDALYQAGLVHVSSAGNQSTDTPRYPAAFPQTISVGATDKQDNKASFSNFGNTVDVYAPGVNVKVADHARDVRTRIARGTSFSAPYVAGIIALMLEGSDKPRKSEHVDTIRQSFLDNAASASKADKRVPHTRFDIEPFKFPKPSPVEKIVQKVSDNKESSTISDKGSKKNYVKEIVAGVILVATIAAILL

SEQ ID NO: 111 - DNA, 1596 bp, Unknown
  Obtained from an environmental sample.
atgtcactatccattcatcgcagaaatcgaagtgcgttccgaagtggcttcttcgcggtggcgctggccgccagcacactgtacacgctgggatccaccgccgttgccagcgaactgcggacctccgaagaccccatcgaaggacgctacatcgtcgtgctcagggagcaggctgcacgtctgtcatccgaattcaccggccgcgccgacgtgcccgccattgccgatgtggcgcgcacgctggcctcccgccatggcgcgacgctcctgttcagctacgaacatgctctgcgtggcttcgtggtcgatgccgacgacaggacgctggcgcaactgctggccgatccacgcgtggagtacgtcgaggaggacggccatgtgctgctgaactcgacgacgcagccgaacgcgacctgggggctggatcgagtcgaccagcgctttcttccactcaacagcacctacgtctacgacaccacggccgccaacgtgcgcgcctacatcatcgattcgggcgtgctgaccgcgcacagccagttcggcggacgcatcggcaacgggttcagcgcgatcaacgacggtcgtggcgtacaggactgcaatggccacggcacacatgtggccgggacggtcgccggcagtacatggggcgtggccaagggcgtgatcgtgcatccagtgcgcgtgttcggctgctccggcggctcggcctggtcgacgatcatcgccggcatcgactgggtacgcggcaaccacgtcaagccggcggtggcaaacatgagcctgggtggcggcggcaattcttcggcggatacggcgaccaacaacctcatcaacgccggcgtgaccgtcgtggtcgccgcaggcaactcgaatgacaacgcctgcctctactcgccggcacgggtcgcgaacgccatcacggtgggctcgacccagagcaacgacgcgcgttcctggttctcgaactggggcaactgtctggacctgttcgcgccgggatcggcaatcacctcggcctggtggaccagcaccaccgccagccacacgatcgacggcacctcaatggcggcaccgcacgtggcgggtgccgccgccctgtacctggccaacaaccccggcgcttcgccggccaccgtacgcaacgccatcatcaccaacgcgacaaccaatgtcgtctccaacccgggcgccggttcgcccaatcggctgctgtacacccggtttgccgcggcaccgccaccaccgccaccgggctgcggccgtctcaacggtggtcagacgctccagaccggccaatcggcggtttcctgcgatggacgcttcaccttcgtgatccagggcgatggcaatctggtgctgtatcaggccggggtgggtgcgatctgggccaaccatgtctacggcagcggtcatcgcctgtcgatgcagggcgacggcaatctggtggtctacaacagcgtcaaccaggcgcgctggcataccggcacccatggtcaccctggtgcgtggctggccgtccagaacgatggcaacgtggtcgtctacagcgccggcggtcagccgctgtgggccactcatacctgctgccgctga

SEQ ID NO: 112 - protein, 531 aa, Unknown
  Obtained from an environmental sample.
  SIGNAL (1)...(36)
MSLSIHRRNRSAFRSGFFAVALAASTLYTLGSTAVASELRTSEDPIEGRYIVVLREQAARLSSEFTGRADVPAIADVARTLASRHGATLLFSYEHALRGFVVDADDRTLAQLLADPRVEYVEEDGHVLLNSTTQPNATWGLDRVDQRFLPLNSTYVYDTTAANVRAYIIDSGVLTAHSQFGGRIGNGFSAINDGRGVQDCNGHGTHVAGTVAGSTWGVAKGVIVHPVRVFGCSGGSAWSTIIAGIDWVRGNHVKPAVANMSLGGGGNSSADTATNNLINAGVTVVVAAGNSNDNACLYSPARVANAITVGSTQSNDARSWFSNWGNCLDLFAPGSAITSAWWTSTTASHTIDGTSMAAPHVAGAAALYLANNPGASPATVRNAIITNATTNVVSNPGAGSPNRLLYTRFAAAPPPPPPGCGRLNGGQTLQTGQSAVSCDGRFTFVIQGDGNLVLYQAGVGAIWANHVYGSGHRLSMQGDGNLVVYNSVNQARWHTGTHGHPGAWLAVQNDGNVVVYSAGGQPLWATHTCCR

SEQ ID NO: 113 - DNA, 4818 bp, Unknown
  Obtained from an environmental sample.
ttgaccaataagaaattcaccaaatttctaagtgcatttctaacactcattatggtcctttcgcttgttctgccattcaacggtactgcaaatgcagctctattgaaacagccgttcaagacgaatccgcaagacgcaagtgcgcttcagcaaaaagctgcgattgcacagcagacaagcttgctggaaggggatgcccgactccacaaggatctgcaaggtctatctggcagtcaggaagttccagtcatcattcatttatccgaaaaagcggttggccttgaacaggggatccataagctcaacgggaaaaagatgagccaatccgagattactctcaaaaagggtaaaatccaggcccagcaaaacacggcacgtaaggaaatgacggttaaaaaagtgaaattcgaccaagtttactcatacgatacagtcctcaacggtctctccggaacagttcaagcgaacgacctcaagaaactcctaacaataagcggcgtgaaatacgtcgaacctgatacaaccgtctatgcacaggaaggtcttcaaaaagtcgacccgaaagtggatgcaaagatggacacaagcattccatttttaggcattaacaagctatgggaagaaggtattgaaggacaaggcgtcaaagtggcggttctcgatacaggcatcgacgcatcccatcctgacttgaaagcggtttataaaggcggtaaaaacttcgtccctcacgtagacggggagtacgcacgtccacgcgcagatgacgatggttctgaaacgtctccgctcgatcgtcctgcaaacaagcctgaagtgaacgagcgaggcagctcattctatacgacccacggaactcacgtggcaggaacgattgtagcacaaggtaacaacgaattcggcatcaaaggcattgcaccgaaagtcgacctctattcatatcgcgtcctcggcgcttacggaagtggcgcgacttcaggcatcattaaagcgatcgatacagcagtcattgaaaagattgacgtcatcaacttatctctcggtggtggtgcgaactccgaaacggatggcgcgtccttcgcgatcaacaacgccatgcttgcgggcacgatttctgttgttgcaacgggcaactcaggcccgaaccggggcacaatgggaactccggcaacatcacgactcggaattgcagtagggaatacgacaaaccctgaaacacatttccaagcgaacgtaaacgtaaaagcaggtgaattcacttacagtaaagtgaatgacctgatggcaacgacattcggcaaagacgtagaaacacaattagcaggcggttacgatctcatcgcagttcctggagcgggtgctgaaaaagactacgcagatctagacgtaactggcaaagtggcactcgtcgcacgttcagaaatcgcgttcgttgataaagtcgcagcggctaagaaaaacggtgcagttgcaatcatcgtacacaactttgcgggcggtacaaatgcaccgaacaaatcagacgtattccttggcgacgcattcgaattcatcccgacattcgatatgtctgtaacagatggggaagccctgcgtgcagcactcgctgcagcgccaagtacgatttccttcgatcaattctcaagcatcaaaacaacaggtgatgacgtcaatgactcaagttcacgtggtccatccacaccgaacttcgacatcaagccagacgtttctgcacctggaaccaacatcatgtcaacaattccgatgtacgggaacgatttcccggatgcagattacagcgaggcctactcacgtaaaacaggtacatccatggcaactccacacattgctggaattgcggcactcgtgaaacaagcgaatccgacatggaacgcatttgacgtaaaagtggctctttccaacacagcaacagtactcgatacgaaaaagtatgacgtcttcgctcaaggagcaggacgcgtggatgcttacaaagcggcgcgcgcagatgttcttgcttatgcgatcgatacagcaagcaatgacggaacagaagtggaaaacttaaaaggaaccgttacattcggtcctcaaaagttggataaaaacatctctgtcactaaaaaaatcaacgtaaaagatttgaaatcagctggcggcgactataccgtttctgttgacgtaacaaaaggattcggcgacgcaaaagtcacggttgatcaatccgaattcacattaaacggtgaacaacttctgaacgtaactctgacggcgtcaaaagcagagacaaaagcgggggatgaaatcctcggctacatccacatcaaaggtaacggcaaagatctttcattaccattcgcagctgacttcggtggagcagccgcagtcgcagttaaagatatggaaatcacgaaaacggatctttcattcaatggagacggtgtgaacgatgatgccatgttgtacttcacaataactggcgatgtcggtttcaacacgatcgagctgtgggatatcatgaacccgaccggcggcaagtatagcgacggctacatcggatatttgcacgcaagtgataccctaacggcaggatcctaccaacttccgatactaggtaagtacacacaatggggcggtacagcgtcggaagtgattccggatggcttgtacacaatcgacttctctgctgaaacgaagtcaggaaatcccaaaacgatcgctgattacgtaggtccagtagttgtgaaatcgactgcaggcacaatcgaaggggcggttgcagacggaaaagtaactggtaaaatcaccgacaaatacgtcgattaccaaaaagagctcgtgaaatacggaatgggctacgacctcaatacaaaactttcggcaacatacgaagtgacagcaaatgatgcagtcgtggattccggtgcagtgaagttggcacaggacggcacattcgcattcgaccttccgactttcgataaaacaaaaaacaatgtcactgtgaaatacgcagacgctgctggcaacaaagcggaagaagtcatctacacagctatcgatgaaccggtggacacagtttctgttgcggtcgatcaaaccgcactcgacttgaaagtgggagacacagctcaacttctcgtcacggaaacaacaacgaagccagacggcacttcgactgaccgcgacgtaactgcagaagcaacgttcgcttcaagcgacgcagcagttgcaaccgttgtaaacggaaaagtgacagcggtcgctgcaggtaaagcggagatcacggtcacatacaatgacttcacacaaacagttcccgttactgtaactgcggaacctgtgaaggaagaaatcagctacgcactgaacaagaagagcttgtctctaggcgttggtcagcaagaacagctgacaatcacggaaacgaaagtgaaagctgacggtacagtcgtgaaaacggacgtcacgccaacagtgagcttcaatgtagtcgataactcaatcgctacggtccacaaaggactcgtcactgctcacaaagcaggcaaaacgcaagtccgtgtcatgattcctgggcaggatacacgcttcgtttatctcgaagtgaaagatcttccgcaagacgtggtgacctattcggtggataaaactgctttgaaattaggtgtaggccagcaggaacaactgacagtcaagcaaacgaccgtgaagccggacggtacagtcgttgagaaagacttcacgccatccacaagcttcaacgtagtggataaaaaaatcgctacggtttcaaaaggactcgtcactgctcacaaagcaggcaaaacgcaagtccgcgtcatgattccaggagaagacacgatcttcgtttacctggaagtcgtcacgcctccacaaaacatcgtcacctattcggtggataaaaccgacgtgaagatgcaagtgaatcagcaaacgcagattaagataactgagaaaacagtgactccagatggcaaaatcactgaaaaagacgtaacaggcgcaagcaagttcagtgtcgtcaacaacaaaattgcaacagtcaacaaaggtttgatcagcgcgctcacgccaggcaaaacacaagtgaaagtcgtcttgccgaacggtgaaagcctactcgtctacttggcagtaaaaggcgaacccgcgccaattatcacgtattctttggacaaagacagtgtctccttgaaagcaggggactcagcgaatgtccaactcgtcgagaccacgacaaaagcggacggcacgtcgacaacaaaagacgtgacaacagaggcgacataccagacgaataatgccgacgttgcaacagtaacccaaggtaaaatctctgcaatcgcagcaggggatacagaaatcagcgtcaccctcggcgcgttcgaaacgactgtgaaagttcacgtagaagcagttgcaccgaaagcgatcgtagttacagatgagatgatcaatgcgttcatcgcggataaaaaagcgaagcagatcatcatcgaagtaccagcagctgtcggtctaatggacgtggaattctcaaaagcgatcttgaagaaaatcgagaagtctgagaaagacctcgtgcttaaagcaggaaacgcagtctacacactcgaagacgatgctgttgaagaactgatgaaccgctctggcggagacgcagtcatcacactcggcacatcttcatctgccaacgtgaaggatgccgtctcagaggtctacacaatcgagttttcaactggcactgcagctaacaaatccgctttgaaaaaattcgatgaagaaatattagtcgca

SEQ ID NO: 114 - protein, 1606 aa, Unknown
  Obtained from an environmental sample.
  SIGNAL (1)...(32)
MTNKKFTKFLSAFLTLIMVLSLVLPFNGTANAALLKQPFKTNPQDASALQQKAAIAQQTSLLEGDARLHKDLQGLSGSQEVPVIIHLSEKAVGLEQGIHKLNGKKMSQSEITLKKGKIQAQQNTARKEMTVKKVKFDQVYSYDTVLNGLSGTVQANDLKKLLTISGVKYVEPDTTVYAQEGLQKVDPKVDAKMDTSIPFLGINKLWEEGIEGQGVKVAVLDTGIDASHPDLKAVYKGGKNFVPHVDGEYARPRADDDGSETSPLDRPANKPEVNERGSSFYTTHGTHVAGTIVAQGNNEFGIKGIAPKVDLYSYRVLGAYGSGATSGIIKAIDTAVIEKIDVINLSLGGGANSETDGASFAINNAMLAGTISVVATGNSGPNRGTMGTPATSRLGIAVGNTTNPETHFQANVNVKAGEFTYSKVNDLMATTFGKDVETQLAGGYDLIAVPGAGAEKDYADLDVTGKVALVARSEIAFVDKVAAAKKNGAVAIIVHNFAGGTNAPNKSDVFLGDAFEFIPTFDMSVTDGEALRAALAAAPSTISFDQFSSIKTTGDDVNDSSSRGPSTPNFDIKPDVSAPGTNIMSTIPMYGNDFPDADYSEAYSRKTGTSMATPHIAGIAALVKQANPTWNAFDVKVALSNTATVLDTKKYDVFAQGAGRVDAYKAARADVLAYAIDTASNDGTEVENLKGTVTFGPQKLDKNISVTKKINVKDLKSAGGDYTVSVDVTKGFGDAKVTVDQSEFTLNGEQLLNVTLTASKAETKAGDEILGYIHIKGNGKDLSLPFAADFGGAAAVAVKDMEITKTDLSFNGDGVNDDAMLYFTITGDVGFNTIELWDIMNPTGGKYSDGYIGYLHASDTLTAGSYQLPILGKYTQWGGTASEVIPDGLYTIDFSAETKSGNPKTIADYVGPVVVKSTAGTIEGAVADGKVTGKITDKYVDYQKELVKYGMGYDLNTKLSATYEVTANDAVVDSGAVKLAQDGTFAFDLPTFDKTKNNVTVKYADAAGNKAEEVIYTAIDEPVDTVSVAVDQTALDLKVGDTAQLLVTETTTKPDGTSTDRDVTAEATFASSDAAVATVVNGKVTAVAAGKAEITVTYNDFTQTVPVTVTAEPVKEEISYALNKKSLSLGVGQQEQLTITETKVKADGTVVKTDVTPTVSFNVVDNSIATVHKGLVTAHKAGKTQVRVMIPGQDTRFVYLEVKDLPQDVVTYSVDKTALKLGVGQQEQLTVKQTTVKPDGTVVEKDFTPSTSFNVVDKKIATVSKGLVTAHKAGKTQVRVMIPGEDTIFVYLEVVTPPQNIVTYSVDKTDVKMQVNQQTQIKITEKTVTPDGKITEKDVTGASKFSVVNNKIATVNKGLISALTPGKTQVKVVLPNGESLLVYLAVKGEPAPIITYSLDKDSVSLKAGDSANVQLVETTTKADGTSTTKDVTTEATYQTNNADVATVTQGKISAIAAGDTEISVTLGAFETTVKVHVEAVAPKAIVVTDEMINAFIADKKAKQIIIEVPAAVGLMDVEFSKAILKKIEKSEKDLVLKAGNAVYTLEDDAVEELMNRSGGDAVITLGTSSSANVKDAVSEVYTIEFSTGTAANKSALKKFDEEILVA

SEQ ID NO: 115 - DNA, 2487 bp, Unknown
  Obtained from an environmental sample.
gtgagaaagtcactggtacggcgaggtctgggggcggcgctgccgctggccctgaccgtcgccatgagcatgggcctgctgtcgcagccggccggcgcagccgggaacaccggctccgtcgcgcacgtcgcggcggacgacccggaggacgcaggacccccacccgtagcgcagtcccccacagccgagacggagcacgtcgcgcacggacgcacgaaggtgtccgagcttccgccactggccgcgagcaaggacccgctcaaggaggtgtacggcaagaccgcgaaggcgccggtccgtccctcgaagtcgatggagaaggcggttgccggcaagaccggcaagtcccgtgcgcttgccgccgcgtgcaacgtctccgacttcaccagccgaagcggcggcgcgctggtccagcagatcaaggcgtctacaaccgactgcgtcaacaccctgttcaacctgaccgggtcggacgcctactacgccttccgcgagtcgcagatggcctcggtcgcctacgccctgcgcgacggctcgacgtcctacccgggtaacgcctccaccggtatgccgcagctcgtgctctacctgcgcgccggctactacgtccactactacaacgcaagcacggtgggctcctacggcagcagcctgcagaccgcgatacgcgccgggctcgacgccttcttcgccagcccgcgctcacgcgacgtcaacgacgccaacggcgagacgctcgccgaggcggtcacgctcatcgacagtgccgaggagaacgcccgctacatccacgtcgtcaagcgcctgctggcggattacgactccacctggaactcctcctggtggatgctcaacgcggtcaacaacgtgtacaccgtgaccttccgcggccatcaggtgcccgcgttcgtgagtgccgtgcagtcggaccccggtctgatcgacgcgctctacaacttcgcgagcggccacctcgcgctgctgggaacggaccagtcctacctcacgtcgaacgcgggacgcgaactcggcaggttcctgcagcactccccactgcgctccaaggtccgccccctggccgcgggcctgctcaactccagctccatcaagggccgaacggccccgctgtgggtcggtgtggccgagatgaccgactactacgacaaggccaactgctcctactacggcacctgcgacctccaggcccaactggcccgctccgtcctgacggtgacctacccctgcagctccagcatcaccatcaaggcgcagcagatgacctcgggcgagctgtcctccagctgcagcagcctgcgcaaccaggacgcctacttccacaacgtggcccgtgacaacggccccgtcgcgaacgacaacaacagcaccatcgaggtcgtggtcttcgactccagcaccgactaccagacctacgccggcgccatgtacgggatcgacaccaacaacggcggcatgtacctggaagggaacccgtcggcggccggcaaccagccgcgattcatcgcctacgaggccgagtggctgcggcccgacttccagatctggaacctcaaccacgagtacacgcactacctcgacggtcgcttcaacatgtacggcgacttcaacgccaacatcaccaccccgaccatctggtggatcgaaggcttcgccgagtacgtctcctactcctaccgcggtctcccctatacggaggcgacgaccgaagcaggccgtcgcacgtacgcgctgagcaccttgttcgacaccacgtacagccacgacaccacgcgcatctaccgctggggctacctcgccgtgcggtacatgctcgagaaccaccgcgccgacatggacaccgtcctcggctactaccgcgcgggaaactggaacgccgcacgttcctacctgaccggcaccatcggcacccgctacgacaacgactggtacacctggctggcggcctgcgcggccggcaactgcggaggcgggggcaccaacccgcccggcaaccaggcgcccaccgccgcgttcaccaccgccgtccagggcctggacgtcaccttcaccgaccagtccacggacgccgacggcaccatcgcctcccggtcctggagcttcggtgacggcaccacctccacggccaccaaccccgtcaagaggtacgggtcggccgggtcctacacggtgaagctgaccgtcaccgacgacaagggagccaccgccaccgcaacgaggacggtcaccgtagccagcggcggaggcggcggcaccgagtgcaccggaaccgacacccgggaactgggccagaactgccaacgcggcaaccagtccgccaccgccggcaactacgcctacctgtacctctacgtcccggccggcaccacccagctgaagatcaccacctccggcgggacgggcgacgcggacctctactacagcaccagcggctggcccggcaccacgagctacacgcagcgtgcgacggga

SEQ ID NO: 116 - protein, 829 aa, Unknown
  Obtained from an environmental sample.
  SIGNAL (1)...(33)
VRKSLVRRGLGAALPLALTVAMSMGLLSQPAGAAGNTGSVAHVAADDPEDAGPPPVAQSPTAETEHVAHGRTKVSELPPLAASKDPLKEVYGKTAKAPVRPSKSMEKAVAGKTGKSRALAAACNVSDFTSRSGGALVQQIKASTTDCVNTLFNLTGSDAYYAFRESQMASVAYALRDGSTSYPGNASTGMPQLVLYLRAGYYVHYYNASTVGSYGSSLQTAIRAGLDAFFASPRSRDVNDANGETLAEAVTLIDSAEENARYIHVVKRLLADYDSTWNSSWWMLNAVNNVYTVTFRGHQVPAFVSAVQSDPGLIDALYNFASGHLALLGTDQSYLTSNAGRELGRFLQHSPLRSKVRPLAAGLLNSSSIKGRTAPLWVGVAEMTDYYDKANCSYYGTCDLQAQLARSVLTVTYPCSSSITIKAQQMTSGELSSSCSSLRNQDAYFHNVARDNGPVANDNNSTIEVVVFDSSTDYQTYAGAMYGIDTNNGGMYLEGNPSAAGNQPRFIAYEAEWLRPDFQIWNLNHEYTHYLDGRFNMYGDFNANITTPTIWWIEGFAEYVSYSYRGLPYTEATTEAGRRTYALSTLFDTTYSHDTTRIYRWGYLAVRYMLENHRADMDTVLGYYRAGNWNAARSYLTGTIGTRYDNDWYTWLAACAAGNCGGGGTNPPGNQAPTAAFTTAVQGLDVTFTDQSTDADGTIASRSWSFGDGTTSTATNPVKRYGSAGSYTVKLTVTDDKGATATATRTVTVASGGGGGTECTGTDTRELGQNCQRGNQSATAGNYAYLYLYVPAGTTQLKITTSGGTGDADLYYSTSGWPGTTSYTQRATG

SEQ ID NO: 117 - DNA, 1356 bp, Unknown
  Obtained from an environmental sample.
atggcgaccaaggccaagaagggttcccgcgcatccgtcagatcgactggaaccgatgacactggaaccggcgcacccggacttgactgcccggttcagcgcctgatcgacgcggcgcttgaacatccgcagggccataccggccgctacatcgcgatcatgcgtgaggatgccgaaggcgatactgaagcggtgatgtcgaattcctttgccgccacctcggcaaacagccgtgacttcggcacccgcggtttcgcgatggatgagatttcgggggcggactcgctggtgctgaacacgctgggcatggcggttctgggcggttccgccgccgacgcggcgcgcgaaagcatgacgcgctctggcgacagtttcgggactgctgccgagttgccctatgtgctcgaacccgaaaccatcgaatgggtgctgatcgacccggccagctatctcatgggctttcgtgctgcctcggaccggatcgcgaccgatcttctggggcaacctgtgccgtcgcagttcgaaccggcccccgccgacgtcactgctgctgccggcgggatgacctggggcctttcggcgacccgcgtcggtgccagcacggcgaccgggcgcggcatccgcgtggcgatccttgataccgggcttgatctcggccacccggatttcgcgggccgcaggatcctggcgcagtcgttcatcgcgggcgagacaccgcaggatgtcaacggccacggcactcacgtgaccggcaccgcttgcggcccgagggtgcccgcgaccggcggcaaccgctatggcatcgcccacgagtgcgaaatcctggtcggcaaggtgctgagcaacgccggtgccggaccgggccttggcatcgtgatgggcatcgactgggcgctggcgaacggcgcgcatatcatcaacatgtctcttggcagcccggcagcggcggccaatctcaagtacacccaggccggtaagcgggccctgacccgcggcgcgttgattgtcgcggcggcgggcaacgacaacgcgccgaccggccagcccgccaattcgccgacgatcctgtcggtggcctcggtgaactcgttcctgcagaagtcgggcttttcaaacttcggcaaggtcgaacttgcggcaccggggtcttccatcgattcgtccctgccccgtccgcgcaggcgcgggttcctcagcggtaccagcatggccgccccgcatgtcacggggattgctgcccttcatgcccaggccactggcctgcgcggcaaggcgctgtgggcccatctcgagtctcgcgccaaggcgctgtcgctgccgccccagaaccgtggggcagggctggtgcaggcatga

SEQ ID NO: 118 - protein, 451 aa, Unknown
  Obtained from an environmental sample.
MATKAKKGSRASVRSTGTDDTGTGAPGLDCPVQRLIDAALEHPQGHTGRYIAIMREDAEGDTEAVMSNSFAATSANSRDFGTRGFAMDEISGADSLVLNTLGMAVLGGSAADAARESMTRSGDSFGTAAELPYVLEPETIEWVLIDPASYLMGFRAASDRIATDLLGQPVPSQFEPAPADVTAAAGGMTWGLSATRVGASTATGRGIRVAILDTGLDLGHPDFAGRRILAQSFIAGETPQDVNGHGTHVTGTACGPRVPATGGNRYGIAHECEILVGKVLSNAGAGPGLGIVMGIDWALANGAHIINMSLGSPAAAANLKYTQAGKRALTRGALIVAAAGNDNAPTGQPANSPTILSVASVNSFLQKSGFSNFGKVELAAPGSSIDSSLPRPRRRGFLSGTSMAAPHVTGIAALHAQATGLRGKALWAHLESRAKALSLPPQNRGAGLVQA

SEQ ID NO: 119 - DNA, 1590 bp, Unknown
  Obtained from an environmental sample.
atgaccatggctgatccaaagcgctatttgattcttccagcacggggacttcaggcaactgccgaaaatgcaggcacggaggctcgcgacttcctgatgagtctcaatgcaggcagcgcggcgacacttcgcactcgtctgcagaaaacgatttctgcaggagccagtgcggtgcggggtgccggaaacaaattgaaactgaaagctgaaaaggcgcagaaatcagcctttgaaatcgtctcctcactcaacgaagacggggtcaagctggtgagtgctacgcccgaaatgatagccgctatgcgatttgatcagccgggcttgcgagtggtgcctgaagcattttgttctccggcgagagcagttgtgcgccttctcaggacggtcacgaaaacggccgctgcagcgaccgccgtccagcgcaaattgaaaattaccgtgctccggagcgatacgcagcagccggtgtcaggtgttgacatcattgggtttacgaatttcgaacaacgagagggagtacagggggtcacgtcggcgagcggcaaggtgacgctgacagtttccgggagtctgaaattccagcggctctatgtacaacatgaacaggttgggctgtggagctttctgggtaagaatgtgagcacggatggaaccctgacaatcacattgcaggcgttgagcctggctacggtcgattccctccggcattttcatggacttggagggaatgcggatggtaccggcgtcaaggttggggtgattgattcgggaattgccctcaatcatcctgatcttcgggtgagtggcggattgggctgcgttcctggcgaaccagaaagtgattttggtccccgcggcggaattcacggctcacacgttgcgggaataattgcgggacgtggcaacgctccaaccggaatgcgcgggcaggctcccaatgcggaaatcttctcgtatcgcgtttttggaaacacctcttcgtcggggtcaaattttgccctcgtgaaagcgattcagcgaggagtcgcggatggctgtgacttacttaatatgagcctgagttttgatcccgatgtgaacggcgttcctcaagtcgatgccgcggtgcaggaggcaatccgcgaggcacatcagaagggcgtgctggtgatcgcggcggcagggaatgatggacgtcgctcggtaagttatccagccatggatgacatggttgttgcggtttccgcagtggggcgaaaagggacgtttccggcgaaatccggcgagtcaggtgatgttctcgcaccatttggagccgcccctaaagatttcctcgcggcattttcaaacgtcggaaccgaactcgatgtaaccggtgctggcgtcggagttgtttcgacagcaccgggcggctacatcccgatgagtggcacgtcgatggcttgtcctgctgtgacgggtgtcctggcgcgcctgctggcaaatactcccgccgtactcaatatgcaacgagactcgaatcgcaccgatgcgatcaaggctttgttgttcagcaatgcacagaccctgggtttcgatctcagatttgaaggcaaaggtttgccaaagtag

SEQ ID NO: 120 - protein, 529 aa, Unknown
  Obtained from an environmental sample.
MTMADPKRYLILPARGLQATAENAGTEARDFLMSLNAGSAATLRTRLQKTISAGASAVRGAGNKLKLKAEKAQKSAFEIVSSLNEDGVKLVSATPEMIAAMRFDQPGLRVVPEAFCSPARAVVRLLRTVTKTAAAATAVQRKLKITVLRSDTQQPVSGVDIIGFTNFEQREGVQGVTSASGKVTLTVSGSLKFQRLYVQHEQVGLWSFLGKNVSTDGTLTITLQALSLATVDSLRHFHGLGGNADGTGVKVGVIDSGIALNHPDLRVSGGLGCVPGEPESDFGPRGGIHGSHVAGIIAGRGNAPTGMRGQAPNAEIFSYRVFGNTSSSGSNFALVKAIQRGVADGCDLLNMSLSFDPDVNGVPQVDAAVQEAIREAHQKGVLVIAAAGNDGRRSVSYPAMDDMVVAVSAVGRKGTFPAKSGESGDVLAPFGAAPKDFLAAFSNVGTELDVTGAGVGVVSTAPGGYIPMSGTSMACPAVTGVLARLLANTPAVLNMQRDSNRTDAIKALLFSNAQTLGFDLRFEGKGLPK

SEQ ID NO: 121 - DNA, 1557 bp, Unknown
  Obtained from an environmental sample.
atgaaaacgtcgaaaaagttgatggcggtgctggtcagcgcggcctttgtaatggcgacccagtctgctgacgcagccgatttgcggctgacccagacgccagtcagcggtcgctacatcgtagtgctgaaggaatcggcagcccgcttcagcagcgaagcgtcgatcgcccaccggcgcaatgtgccggaggtggcgcaggtggccagccaattggccgctggcggccggggcatgcgggtatcgcgcagcttcaacaatgcgctgcgcgggtttgtcgctgataacaccagtgacgccgatctggcgcgcctgctgcaggacccgcgggtcgactacgtcgaagaagacggcgtggtgcatgcctttgccacccagagcggggcgacctggggcctggaccggatcgatcagacggcgctgccgctgaatggtcaatatgtctatgacagcaccgccagcaatgtgaatgcctacatcatcgataccggcatccgcgccagtcacagcgatttcggcggccgggtcagcggcggttatgacgcggtcaacgacggcaacggcaccaatgactgccagggccatggcacccatgtcgccggcacggtcggcagcgccacctatggcgtcgccaagggcgtgcacctggttccggtacgggtgctgggctgtgatggttccggcaccaactcgggcgtcatctccggcatcgactgggttcggagcaaccacagccgcccggcggtggccaatatgagcctgggcggcggcgcctcaacggcggttgacagcgcggtggccaatctcagcgccgccggcgtcgtggtggtggtcgccgccggcaacgacaataccagcgcctgcgactattcaccggcgcgggcgccaagcgcgatcacggtcggctccaccaccaataccgatgcgcgctcgtcgttctccaactacggccagtgtctggatatcttcgcgcccggctccaacatcctgtcgactgccaacagcagcaacagcgccaccaccacgatgagtggcacgtcgatggcctcgccgcatgttgctggcgccgccgcgctctacctggccagtaaccccagcgcatcgccggccgcggtggcgacggcgttgggcaaccaggcggtcgccaatgcggtgagcaatccgggctccggctcacccaaccgactactgcaaagtcgcgccggcggcagcaacccgccaccgccacccccgcccggcggcggtgacccctgcacggcctgcgccaagtacagtggcagcttgtattacagcggcgactacggctaccaacctgacggtaacttctactatgcctccagcggccaacaacagggctggctgcgcggccccgccagcaccgacttcgacctcgaactgctgcgctggagtggctatggttggaccaaggtggcgcagagcgtgggctcgaccagcagcgaacaggtcagctactacggcagcgctggctactacatgtggcgagtggtgtcgtattccggaagcggcaatttcgacttctacttgagcattccgtag

SEQ ID NO: 122 - protein, 518 aa, Unknown
  Obtained from an environmental sample.
  SIGNAL (1)...(25)
MKTSKKLMAVLVSAAFVMATQSADAADLRLTQTPVSGRYIVVLKESAARFSSEASIAHRRNVPEVAQVASQLAAGGRGMRVSRSFNNALRGFVADNTSDADLARLLQDPRVDYVEEDGVVHAFATQSGATWGLDRIDQTALPLNGQYVYDSTASNVNAYIIDTGIRASHSDFGGRVSGGYDAVNDGNGTNDCQGHGTHVAGTVGSATYGVAKGVHLVPVRVLGCDGSGTNSGVISGIDWVRSNHSRPAVANMSLGGGASTAVDSAVANLSAAGVVVVVAAGNDNTSACDYSPARAPSAITVGSTTNTDARSSFSNYGQCLDIFAPGSNILSTANSSNSATTTMSGTSMASPHVAGAAALYLASNPSASPAAVATALGNQAVANAVSNPGSGSPNRLLQSRAGGSNPPPPPPPGGGDPCTACAKYSGSLYYSGDYGYQPDGNFYYASSGQQQGWLRGPASTDFDLELLRWSGYGWTKVAQSVGSTSSEQVSYYGSAGYYMWRVVSYSGSGNFDFYLSIP

SEQ ID NO: 123 - DNA, 1656 bp, Unknown
  Obtained from an environmental sample.
atgaagaaaaaaagtaaaaactcgcgctcccaacacacaaaacccgcgagtttcaaacaattcttactgaataaaaacgatatttttattcttggcataagttttctattaatcgtgggtgttttcttattcctaatgattataccgacggatagaaccgtagggcaagcaatcagttttggagcgagtgaggagttagcgagtgttaacggagatgaaattccttacttattttttggcgatgtcgaggacacccctcttgagtatgatggttacatcattgagttacacgaaaaacccctcgcgcaagtaatagctatgcaagagaatattccttcaggtgattttggagctatgagcacttcatcaagcgcagtgattaatcacgaagcaattattgtatcagaacaacaaaacgcgctagcggacataactatgcgacttagtcaagcacagtcctcatcggaattcggagcgcaagcaaccacatcatcccaggaattaattgttcgagagtcttacagcgttgttttcaacggattctctctcgacattacagatgaacaagcactagcaataaatcaatcaccctacgtgaaaaacgtacatcctaaccgtcgcgtgagcattgcgcttcaagatgccgtacccctcatccaagacggaattctcgcaggcagagtggatgaagacgggaatgattgtgaactaacacaaaaaccctgtttaacaggtgaaggcgttaccatcgctattatagatacaggcgttgattacacgcacccagatttggggggttgcacaacacaagagtttttaggtggagcgtgcgaaaaagtaattggagggtatgatttcattaataatgatgatgatgccatggatgataatggtcatggaacacacgtcgcagggattgctgcaggaaatggcttactaaaaggcgttgcgcccgacgcgaaaatactagcgtataaagttttaggtgctggtggttatggaacctgggaaggaataattgctggaatagaacaagcagttattgatggcgcggatattttaagtttaagtcttggttgtgttcactcttcctgtaatcctgatgatatcgcttctcaagcagttgataacgcagtacttgctggaaaagtagtggtggttgctgcaggaaattcaggaccttcttctcgaacgatcggaagtcctgggactgcacgaaaagcaataactgttggttctacaactaaatcagatattatttcttggtttagttccagaggacctgttgtttggatggatgaagcaggaattgaacaagcaattatgaaacctgatgtgttagctcctggaggaactgatagtggtagtgaattttgtaatcctgaaatgatgtttgataatagaatttgtgctgcttggcttaataaagaatatcttgccatttcaggtacatcaatggcaacacctttagtttccggagcaatagcattacttaaacaaaaacatcccgattggacacctgaagaaattaaaggagcagtaaaaggaaccgcgattaatttaggttatgaccccaacgagcaaggcgctggaagaattaatgtgagagaaatgattggtttggaggaaagagcacttattgcttcaattctttgg

SEQ ID NO: 124 - protein, 552 aa, Unknown
  Obtained from an environmental sample.
  SIGNAL (1)...(56)
MKKKSKNSRSQHTKPASFKQFLLNKNDIFILGISFLLIVGVFLFLMIIPTDRTVGQAISFGASEELASVNGDEIPYLFFGDVEDTPLEYDGYIIELHEKPLAQVIAMQENIPSGDFGAMSTSSSAVINHEAIIVSEQQNALADITMRLSQAQSSSEFGAQATTSSQELIVRESYSVVFNGFSLDITDEQALAINQSPYVKNVHPNRRVSIALQDAVPLIQDGILAGRVDEDGNDCELTQKPCLTGEGVTIAIIDTGVDYTHPDLGGCTTQEFLGGACEKVIGGYDFINNDDDAMDDNGHGTHVAGIAAGNGLLKGVAPDAKILAYKVLGAGGYGTWEGIIAGIEQAVIDGADILSLSLGCVHSSCNPDDIASQAVDNAVLAGKVVVVAAGNSGPSSRTIGSPGTARKAITVGSTTKSDIISWFSSRGPVVWMDEAGIEQAIMKPDVLAPGGTDSGSEFCNPEMMFDNRICAAWLNKEYLAISGTSMATPLVSGAIALLKQKHPDWTPEEIKGAVKGTAINLGYDPNEQGAGRINVREMIGLEERALIASILW

SEQ ID NO: 125 - DNA, 1215 bp, Unknown
  Obtained from an environmental sample.
atgaagtacattgtcattctaaagaaaggttacaatagagattcacttacagactactgcacaaaagtaggtaagccatgtgagctacacaatctcgttatcattaacactgacgaagctacagcaaaaattgttgctgatttagattgtgtagaatctattgagaaagattctgtatgtacatctgatgaggaattttacaagtcatctcgtactactgataattgggcattgacacgattcaattttacagaacctcaacgagagtatcctgagagttaccgttacaatcgcacaggaaaaggtgtgggcatctacgttattgacagtggtgtccgtactactcatcaagagttagtaggacgtgtagagactgtctacagtgttctcgaaggtaagcaatttgacagtgataatgagctaaacattaaccgtagccatggcacagcagtggcgtcagcagcagcagggaagaagctaggtattgcaagtgaagctactgtctacaacttattcgtagatttttctatgtcagacattatcaaagcgtttgatactgtattgcaccattacaaaaagtctaagagtgctgctgtacttgtgacatcattctcaactttgtcactagcaatgaaacctatctcagacgcactctaccaagcaggtctcgttcatgtatctagtgcaggcaatcagtctacagatactccaagataccctgctgcattccctcagactatctctgtaggtgctactgacaagcaggacaataaagcatcattcagtaactttggcaataccgtagacgtatatgcacccggagtgaatgtgaaggtagcggatcatgcaagagatgttcgtactcgtattgcaagagggacttctttctctgcaccttatgttgctggtatcattgcactcatgctagaagattcagacaagcctcgtaagcgcgagcatgtcgataccatacgacaatccttcctagacaatgctacaagtatttccaaggcagataagcgtgtgccacatacacgttttgacattgaaccgttcaagtttcctaaaccttctcctgtagaaaaaattgtacaaaaggtgtctgacaataaggatacgtcaagtatttcagacaaaaaacgtaaaaagagttacacgaaacagattgtagcaggcgttatcctagcagctactatagttgcaattcttgtgtaa

SEQ ID NO: 126 - protein, 404 aa, Unknown
  Obtained from an environmental sample.
MKYIVILKKGYNRDSLTDYCTKVGKPCELHNLVIINTDEATAKIVADLDCVESIEKDSVCTSDEEFYKSSRTTDNWALTRFNFTEPQREYPESYRYNRTGKGVGIYVIDSGVRTTHQELVGRVETVYSVLEGKQFDSDNELNINRSHGTAVASAAAGKKLGIASEATVYNLFVDFSMSDIIKAFDTVLHHYKKSKSAAVLVTSFSTLSLAMKPISDALYQAGLVHVSSAGNQSTDTPRYPAAFPQTISVGATDKQDNKASFSNFGNTVDVYAPGVNVKVADHARDVRTRIARGTSFSAPYVAGIIALMLEDSDKPRKREHVDTIRQSFLDNATSISKADKRVPHTRFDIEPFKFPKPSPVEKIVQKVSDNKDTSSISDKKRKKSYTKQIVAGVILAATIVAILV

SEQ ID NO: 127 - DNA, 1236 bp, Unknown
  Obtained from an environmental sample.
atgttcaaccgtcgttccatgcttgccgtcgccattggcgccggcgtcctgagcaccttcggtgcgggggccctgcaggcctccgagctccgcttcgcggagaacccgatcgaaggccagtacatcgtcgtcctgaaggatgacgccgccacgctcgagggcgagacctcgatcgcgtccaaccgtcccaacgtggccacggccgcacgcaacctcgcccgcgcgcaccgcgccgaggttcgccacacctacaaccgcgccctgcgcggattcgtggcccgtgccgacgagcgtgccctggcccgcctgctgcaggaccccagcgtcgcctatgtcgaagaggacggcatcgtcaccacccaggccacgcagaccggcgcgacctggggcatcgaccgcatcgaccagcgcaccctgccgctgaaccagacctacgtctacgacaccaccgcgtcgaacgtgaacgtctacatcgtcgacaccggcatccgctcggcgcacaacgacttcggtggccgcgtgcgctcgggctacaccgccatcaacgacggccagggcaccaacgactgcaacggccacggcacccacgtcgcctccaccgccgccggcgccacctatggcgtggccaaggccgcccgcctgtatccggtgcgcgtgctcggctgcaacggctcgggcaccaactccggcgtgatcgccggcatggactgggtcgccagcaaccacgtcaagccggccgtggccaacatgagcctgggcggcggcgcctcgtccgccaccgactcggccgtcacccgcatgcgcaatgccggcgtgaccgtggtcgtggccgcgggcaacgacagcggcaacgcgtgcaactactcgccggcgcgctcgacctcggcgatcaccgtgggttccaccaccagcaccgacgcgcgctcgaacttctccaacttcggcacctgcgtgaacatcttcgcgccgggttcctcgatcactgccgcgtggcacaccagcaacaccgcgaccaacaccatcagcggcacctcgatggcggcgccgcacgtggccggcgtggccgcgctgttcctggccaccaaccccaacgccaccccggcccaggtcgagcaggcgatctacagcaactccacgcccaaccgcgtcaccaatccgggcagcggctcgcccaatcgcctgctgtactcccgattcggcggcggcaccgacccgggtcccgatccggatccaaag

SEQ ID NO: 128 - protein, 412 aa, Unknown
  Obtained from an environmental sample.
  SIGNAL (1)...(27)
MFNRRSMLAVAIGAGVLSTFGAGALQASELRFAENPIEGQYIVVLKDDAATLEGETSIASNRPNVATAARNLARAHRAEVRHTYNRALRGFVARADERALARLLQDPSVAYVEEDGIVTTQATQTGATWGIDRIDQRTLPLNQTYVYDTTASNVNVYIVDTGIRSAHNDFGGRVRSGYTAINDGQGTNDCNGHGTHVASTAAGATYGVAKAARLYPVRVLGCNGSGTNSGVIAGMDWVASNHVKPAVANMSLGGGASSATDSAVTRMRNAGVTVVVAAGNDSGNACNYSPARSTSAITVGSTTSTDARSNFSNFGTCVNIFAPGSSITAAWHTSNTATNTISGTSMAAPHVAGVAALFLATNPNATPAQVEQAIYSNSTPNRVTNPGSGSPNRLLYSRFGGGTDPGPDPDPK

SEQ ID NO: 129 - DNA, 1248 bp, Unknown
  Obtained from an environmental sample.
atggatctggccgcgcctgcgacgccgccggtgacggtgtgggaatactcgatggacgagcgctaccgcaatcccggctcgccgctgttcaaggtgctgcccaacggcggcagggtcgtgcgccgcgacggcgatgcggtgttcctgcgcggcagcggcgcgaccgcgcagggcgaccgccccttcctcgatcgccacgacctgaagaccggccagaccaggcgcctgttccgcagcgcgccggatgccttcgagcgcgtcgccagcgtctccgacgacggccagcgcctgtacacgctgcgcgaaaccccgaaggacccgccgaacctgttcgtgcgcacgctgggcgcgccggtcgccgatgccgccgaaggcgaagccgtcgtcgcttcctcgccgcggcaggtcacgagctacgtcgacccgaccccggaagtgcgcggcatccagcgccggctggtgacctacaagcgcaaggacggcgtggacctgtcgttcacgctctacctgccgctgggctaccaggccgggacgcgcgtgcccgccgtgctctacgcctatcccgccgactatgccgatccgggcaaggccgggcaggtcaccgggtcgcagcagagcttcacccgcttcccggagtaccgcctgctgctgctcgccggctacgcgatcatcgacaacacctcgttcccgatcgtcggcgacccgcgcaccgcctacgacacctacctgcagcagctcgtcgacaacgcgcaggcggcggtcgacaaggccgtcgagctgggcgtggtcgatcgcgaccgcatcggcgtgaccgggcacagccatggcgcgctgatgaccgccaacctgctcgcgcactcggacctgttccgcgccggtgtcgccagcagcggcggctacaacaagacgctcacgcccttcggtttccagaacgagcgccgctcgctgtggaacgccaagcgcgtgtacgaagaggcgtcgacctactactacgccgacaaggtggacgagccgctgctgatcgtgcacggcgaggacgatgccaaccccggcaccgaaccggtgcagtcgccgaagctcttccaggccatccgcggcaacggcggcaccgcgcgcctggtgatgctgcccttcgagccgcactggtacaccgcgaaggaaaccaatgagcacttcgccgcggaaatgctgatgtggttcgaccgctgggtgaagaacgccggcccgcgcgaggcgaagaaggagtga

SEQ ID NO: 130 - protein, 415 aa, Unknown
  Obtained from an environmental sample.
MDLAAPATPPVTVWEYSMDERYRNPGSPLFKVLPNGGRVVRRDGDAVFLRGSGATAQGDRPFLDRHDLKTGQTRRLFRSAPDAFERVASVSDDGQRLYTLRETPKDPPNLFVRTLGAPVADAAEGEAVVASSPRQVTSYVDPTPEVRGIQRRLVTYKRKDGVDLSFTLYLPLGYQAGTRVPAVLYAYPADYADPGKAGQVTGSQQSFTRFPEYRLLLLAGYAIIDNTSFPIVGDPRTAYDTYLQQLVDNAQAAVDKAVELGVVDRDRIGVTGHSHGALMTANLLAHSDLFRAGVASSGGYNKTLTPFGFQNERRSLWNAKRVYEEASTYYYADKVDEPLLIVHGEDDANPGTEPVQSPKLFQAIRGNGGTARLVMLPFEPHWYTAKETNEHFAAEMLMWFDRWVKNAGPREAKKE

SEQ ID NO: 131 - DNA, 903 bp, Unknown
  Obtained from an environmental sample.
atgattatgaataagtggccccttctgctattgcttagttttctctcttctttggcaaacgcacaggaaaaagagagacaatcttacattataccatatgttggttggaatcaggaaaaactcaactggaatattgctggtaatgaaaatggacaataccccaatgtattatctgaattaaaatggcagcagttgcgtggcccggaaatgggaattatctccgctgtatcaatttcatcaaggtttcaggtgaggtggaatttcagctaccaggcaattacctccggaacagtaaatgatacagattacgcaggcgataacagagcgcttaaaactgctgaattcaatttacaagcagataaaggctatacaattaaaacccgtctggaattatcttatcttctctggactaaccaaacattctcttttagaccacatgcaggatatttcggaagttaccagaagctttatatgctggatggtgatactccgcttattcccggaaaagaattaaaaagcacctataaacccgaatggcacggtgcagttcttggcttagaaacaaacttcaaaaaggaaaactggaatgttaatctcgacatcagcggcatgtatttcccccaatattctgccactgcaaactggaatcttcgggaagaactcagaaggcctgtcagcttcgaacacagatccaaaggaaaaggcttcgatactggacttcgtattggttaccagctcggtcaacgcattcagccttttatatctgcaagatatacacagatagaagcaggaaaaggaacggataaattatatatggcaaacggagatatttacaaaagcaggctgaacgaagttaattctacaagcattagttttggcatcggtgttaaagtactattctag

SEQ ID NO: 132 - protein, 300 aa, Unknown
  Obtained from an environmental sample.
  SIGNAL (1)...(21)
MIMNKWPLLLLLSFLSSLANAQEKERQSYIIPYVGWNQEKLNWNIAGNENGQYPNVLSELKWQQLRGPEMGIISAVSISSRFQVRWNFSYQAITSGTVNDTDYAGDNRALKTAEFNLQADKGYTIKTRLELSYLLWTNQTFSFRPHAGYFGSYQKLYMLDGDTPLIPGKELKSTYKPEWHGAVLGLETNFKKENWNVNLDISGMYFPQYSATANWNLREELRRPVSFEHRSKGKGFDTGLRIGYQLGQRIQPFISARYTQIEAGKGTDKLYMANGDIYKSRLNEVNSTSISFGIGVKVLF

SEQ ID NO: 133 - DNA, 939 bp, Unknown
  Obtained from an environmental sample.
atgaaccccgtgtatcgcagcctcttcgccccggccctgctggccggcgtgatgctggcccatgtgcctgcagccctggcacagacggcaggccccgccccgctccgcatcgccgacctgcgcccggccagcctgcagatcgaaggacgcgacccgcccatgtcgatcgcgtcgcacgtgccgctgctggagatcagcaccgaggacgcctccttcatcaaggtgcatttcgaccacttctccctgcccgccggcctggccctggtggtcgagaaccccgacggcagcgaggcctaccgctacagcagccaccagcgcgacggccacaccttcgaccgcagcctcggccacaacggccggaccagtttctcggccatgtcgatcagcggcccgcgtgcggtgctgcgcctggagggcacggccaccgagcgctggcggccccaccacggcatccgcgtgagcggataccacgagggctacccggacgagatgatcgagaccctgcagtcggagggcctgctcgacgaggtcggcacccaggccatctgcggcagcaacgacaagcgcggcgtggcctgctacgccagctccgagcctgccgcggtcgaccgctcgcggccggtggcccgcctggtgatgagcggctcgctctgcaccgcgtggcgcgtgggcccgaccaaccgcatgttcaccaacaaccactgcatgtccacggcggcgcgcgtggccgcctcggaagtgtggttcaaccaccaggcgccctcctgcggtggcaccagcgcaggcaccgtggtcaaggtggccggtgaccagatgctggccaccaacagctcgctggactacaccctgttcacggtgcgcgacttcgcctcgatcgccagcttcggctacctgggcctggacatcgccagcactggcgtgggcgaccagatccaaaga

SEQ ID NO: 134 - protein, 313 aa, Unknown
  Obtained from an environmental sample.
  SIGNAL (1)...(27)
MNPVYRSLFAPALLAGVMLAHVPAALAQTAGPAPLRIADLRPASLQIEGRDPPMSIASHVPLLEISTEDASFIKVHFDHFSLPAGLALVVENPDGSEAYRYSSHQRDGHTFDRSLGHNGRTSFSAMSISGPRAVLRLEGTATERWRPHHGIRVSGYHEGYPDEMIETLQSEGLLDEVGTQAICGSNDKRGVACYASSEPAAVDRSRPVARLVMSGSLCTAWRVGPTNRMFTNNHCMSTAARVAASEVWFNHQAPSCGGTSAGTVVKVAGDQMLATNSSLDYTLFTVRDFASIASFGYLGLDIASTGVGDQIQR

SEQ ID NO: 135 - DNA, 3105 bp, Unknown
  Obtained from an environmental sample.
atgcttgctatagaaaataataaaaatttcaaactaggtgaaaaaggtcaagatacagtaataagtgcattaggtaaacttatagggaacgcctcttgtaatgctgaagtagttaacaaaacagttcctatattagaacaatattatagagaaatgaacaaatatccaaaggataaattaaaagcggatgctgtatataatcttatgaaagagataaattatgatatattacaatatacatatgatcataatattagagatggtaaaaatacaccttggtccagcaaaatagatcctttcataaatacaatttcaaaatttgcaggtatatctaaagttacagaagataatggctggattataaataatggtatttattatactagtaaattcgctatatatcatagcagtccatctattcctcattcagtaatagacaaatgtcttgaaatccttcctgcttatagtgagcaatattatattgcagtagaaagaataaaggaagattttaattgtaaagattcaaagggaaatgttatagacattgataaattacttgaagatggtaaaaaacattatttacctaaaacttatacttttgataacggaaaaatgattataaaagctggagataaagtagaagaatcaaaaattcaaaggctttattgggcatctaaagaagtaaaatcccaatttcataggataataggtaatgataaacctttagaagcaggtaatgctgatgatgtcctaactatggtaatatataatagtccagaagaatataaactaaatagaactttatatggatatagtgtagacaatggtggaatatatattgaaggaattggtactttctttacttatgaaagaactccagaggaaagcatatatagtctagaagaacttttccgtcatgagtttactcattacttacaaggacgttatttagtaccaggattatttaatgaaggtgatttttataaaggaaatagcggaagaatcacatggtttgaagaaggttctgccgaattttttgcaggctcaactagaacttctgtattaccaagaaaatcaatggttggtggactttctgaaaaccctaaagaaagatttagtgcagataagatattacattcaaaatatgatgatggatgggaattctacaaatatggatatgctttctcagattatatgtataataacaacaaaaaactatttagcgatttagtatctactatgaaaaataatgatgttaaaggttatgaaaacctaatagaaaatgcaagtaaggatcctaatgttaacaaaagctatcaagatcacatgcaaaaattagtggataattacaataattacacaataccactagtatctgacgattacatgaaaaaatatagtaacaaaagcttaaatgaaataaaatcagatattgaaagtactatgaatttaacaaattcgcaaataactaaagaaagttctcaatactttgatacttatactctaaaagcaaattacacattagattccaacaaaggtgaaattgataattggaattgtatgaataataaagttaatgaatctctagagaaactaaacaaattaggatggggcggatataaaacagttactgcttatttctcaaatcctaaagtaaactcacacaatcaggtagaatataatatagttttccatggattattaactcacaacaaaaactttaacgaagcaccaacaattaaattagattttcctaaggaggcaaatacaaacgaaaaaattaaattttctagcgaaggctcaactgatgatggaaaaatagtttcctatgcttgggatcttggagatggtgaaactagctcagaaaaaaatcctactcatgtttataaagctcctggtacttacacagtgaaacttacagtaacagacgacaaaggcattaaatcagaaaaaagtgcatctataaacataaagaaagtacttacaggaaatgcagtatcagaaaaagaaaataacaatgattacgtaaatgctaacccagtttattctaaagatttagtaagtggatctgttagttcatccgacgatagagatattttttatttcaatgttactaagccttcagatataactataaatgcggaaaaaattaataaagataaaagtgaatttacttggcttttatttagcgaagaagataaatcaaactatatagcctatccaaataaaaaactagaaaacttattttatagcactgtaaaaatagataaacctggtaaatactatttagtaatttataaagttagtggagaaaaatcagattatagatttaatatagaaggagatatatcagcatctccaaaagatgatactgataaagatgaattagttatatctgaaaaggaagataataattcttttgacaaagctaatagagtttgtaaaaatcaatcagtaatagctactttagatactaacgatcctcgtgacacatactattttgatgctttaactgctggcaacatagaagtaactatggaaaataccgataataattctaatgaatttaattggcttgcttacagtagcgataatactaataattatattggatatgctacaaaaagagaaggtaataaaattataggaaactttaaagtagataagcctggaagatactatatagtggcttataagacttcttcaaataaaatcaactacaaattaaatataaaaggtgatattgataatgctccaaaaaatgatgaaatttatgaaaaggaaagtaatgattcctttgaaactgcaaataaaattatgcttaatactaccgtattaggcaacttaaatgataaagatgttagagatatctattcatttgatataaaaaaagctaaagatttagacataaaactaaataatttaaatgatttaggattagcttggaatctttataaagaatcagatttgaataattatattgcttatggatcagtttcaggcaatactataaaagggaaatgcaatgtaactcctggtaaatattacttgtatgtatataaatactctggtgacaatggcaattattcattaacaataaaataa

SEQ ID NO: 136 - protein, 1034 aa, Unknown
  Obtained from an environmental sample.
MLAIENNKNFKLGEKGQDTVISALGKLIGNASCNAEVVNKTVPILEQYYREMNKYPKDKLKADAVYNLMKEINYDILQYTYDHNIRDGKNTPWSSKIDPFINTISKFAGISKVTEDNGWIINNGIYYTSKFAIYHSSPSIPHSVIDKCLEILPAYSEQYYIAVERIKEDFNCKDSKGNVIDIDKLLEDGKKHYLPKTYTFDNGKMIIKAGDKVEESKIQRLYWASKEVKSQFHRIIGNDKPLEAGNADDVLTMVIYNSPEEYKLNRTLYGYSVDNGGIYIEGIGTFFTYERTPEESIYSLEELFRHEFTHYLQGRYLVPGLFNEGDFYKGNSGRITWFEEGSAEFFAGSTRTSVLPRKSMVGGLSENPKERFSADKILHSKYDDGWEFYKYGYAFSDYMYNNNKKLFSDLVSTMKNNDVKGYENLIENASKDPNVNKSYQDHMQKLVDNYNNYTIPLVSDDYMKKYSNKSLNEIKSDIESTMNLTNSQITKESSQYFDTYTLKANYTLDSNKGEIDNWNCMNNKVNESLEKLNKLGWGGYKTVTAYFSNPKVNSHNQVEYNIVFHGLLTHNKNFNEAPTIKLDFPKEANTNEKIKFSSEGSTDDGKIVSYAWDLGDGETSSEKNPTHVYKAPGTYTVKLTVTDDKGIKSEKSASINIKKVLTGNAVSEKENNNDYVNANPVYSKDLVSGSVSSSDDRDIFYFNVTKPSDITINAEKINKDKSEFTWLLFSEEDKSNYIAYPNKKLENLFYSTVKIDKPGKYYLVIYKVSGEKSDYRFNIEGDISASPKDDTDKDELVISEKEDNNSFDKANRVCKNQSVIATLDTNDPRDTYYFDALTAGNIEVTMENTDNNSNEFNWLAYSSDNTNNYIGYATKREGNKIIGNFKVDKPGRYYIVAYKTSSNKINYKLNIKGDIDNAPKNDEIYEKESNDSFETANKIMLNTTVLGNLNDKDVRDIYSFDIKKAKDLDIKLNNLNDLGLAWNLYKESDLNNYIAYGSVSGNTIKGKCNVTPGKYYLYVYKYSGDNGNYSLTIK

SEQ ID NO: 137 - DNA, 705 bp, Unknown
  Obtained from an environmental sample.
ttgaaagctgtaccacaggcagatatccctgctggttttgaaaacacacacatgtgtaaagatgtttatcttccgggaactgatccaagaggagctgttattaaaagcacaaaatggccaaatggcagcgtcattactgtaagtctgaacggtggaacagccaaagttcgcagcaaagtaatgcaatatgctaatgaatggtctaagtatgctaacattacttttaaatttattaccagcggaacagcacaaatccgggttacctttacacaaggagcaggatcttattcttatttaggaacacaagctcttaatcgcccttctaactctgaaacaatgaacttcggttggtttaatgattcaacaacagatacagagttcagcagaacaacgattcatgaatttggacatgctctaggtatgatacacgagcaccagcatcctttagctaatatcccttgggataaagaaaaagtgtatacctattatggaggttatcctaactattggtcaagagcacaggtagacagtaacctgtttgcaaaatattctactacacaaacgcaatatagtgcttatgatacacaatctatcatgcattatagcattagtagcagcttgacaacaaacggattcagtgttggcagcaatactgttctttctactactgataagcagtttattgcatcagtatatccaaaataa

SEQ ID NO: 138 - protein, 234 aa, Unknown
  Obtained from an environmental sample.
MKAVPQADIPAGFENTHMCKDVYLPGTDPRGAVIKSTKWPNGSVITVSLNGGTAKVRSKVMQYANEWSKYANITFKFITSGTAQIRVTFTQGAGSYSYLGTQALNRPSNSETMNFGWFNDSTTDTEFSRTTIHEFGHALGMIHEHQHPLANIPWDKEKVYTYYGGYPNYWSRAQVDSNLFAKYSTTQTQYSAYDTQSIMHYSISSSLTTNGFSVGSNTVLSTTDKQFIASVYPK

SEQ ID NO: 139 - DNA, 1428 bp, Unknown
  Obtained from an environmental sample.
atggaaatgtcaggaatgaagcccgtcgacgcaaacaagacccacaagcgcatccggatcgcagccggcaccgtggcgctcgccctgatggcaacgggttccgtcgcgctggctgccggcccgcaggcccgggccgggaacgggacgtggaaagtcagccaggccttcggcaagcagcgcaccggccgcatcgtcggcggcatcggcgcggtgggcgaccgttcgttcacggtgcgcacctcgggctgcggcggcacgatcatcgccgacagctgggtgctgaccgccgcgcattgcggcagccagagcaccgtctgggcaggctcgaacaacaccggcagccagacggcctattccgtcgcgcagtacatccagcaccccaactacagcccgaactcctccgcaggcagttacagcaacgacttcgccctgctccgcatcaacggcacgttcccggcccacctgatccgcgcgaaactgcccgacgcggcgatcatgcaggccatcgccaagccaggcgatccggtgaccacgctgggctggggccggacctcggaaggcggcagcagcaccaccagcctgcgcgaagtgaccgtcccggtcgtgtccgatgcaacctgcgccgcgtcctacaacggcagttccgctgccggcggcctcaagctcaatccggccgtgtcgatctgcgccggcctcgcagcgggcggccaggatgcctgccagggcgacagcggcggcccgctgatcgcgccctacaacggctcgatctacagcatcggcgtcgtgagctacggactgggctgcgcgcggccgaactattacggcgtgtattcggaaacggtcgccgtgctggactggatcaacggccacatcggcaacggcggtggcagcggcaccgtcatcaccgacgtcgttcttgtcgcgtcgaacggctcgaccgcgccggccggccccgcgggctactcgctggtcggttactgggacgtcgacaagggcggcgcccagggcacgtacggcaccaccggaagcttcatgaccgcgctgtacgtgcggcggcagcttccttcggaaaccagcacctgcgtcggcgggatcggcctgtacacctcggccggaagcaccgttcccggcagcatcgcgcccaactggacctatcgcggcatgtgggacatggacaagggcggcggggtcggcaacctcaacagccagtggcaggaatacatgatgggcctgtacaccaggccggcctcgactggccagggcgcctgcctcaccgatgtcgccctctacgcctcgaacggctcgacgcctgtcacgccctcgggcttcagccaggtcggctggtgggacgtggacgcgggcggcgcgttcggcacccagggttccagcggttcctacgtggccacgctgtccacgaagagcgagtga

SEQ ID NO: 140 - protein, 475 aa, Unknown
  Obtained from an environmental sample.
  SIGNAL (1)...(38)
MEMSGMKPVDANKTHKRIRIAAGTVALALMATGSVALAAGPQARAGNGTWKVSQAFGKQRTGRIVGGIGAVGDRSFTVRTSGCGGTIIADSWVLTAAHCGSQSTVWAGSNNTGSQTAYSVAQYIQHPNYSPNSSAGSYSNDFALLRINGTFPAHLIRAKLPDAAIMQAIAKPGDPVTTLGWGRTSEGGSSTTSLREVTVPVVSDATCAASYNGSSAAGGLKLNPAVSICAGLAAGGQDACQGDSGGPLIAPYNGSIYSIGVVSYGLGCARPNYYGVYSETVAVLDWINGHIGNGGGSGTVITDVVLVASNGSTAPAGPAGYSLVGYWDVDKGGAQGTYGTTGSFMTALYVRRQLPSETSTCVGGIGLYTSAGSTVPGSIAPNWTYRGMWDMDKGGGVGNLNSQWQEYMMGLYTRPASTGQGACLTDVALYASNGSTPVTPSGFSQVGWWDVDAGGAFGTQGSSGSYVATLSTKSE

SEQ ID NO: 141 - DNA, 1755 bp, Unknown
  Obtained from an environmental sample.
gtgaaaaagaaagttgtattattggggctgtctatgggtctattaagtaatcctgctattggaacggtatgggcagaaggagctgcgaatcctgtattttttcagaatgagaatgaagaatcgaccacgtttacttcaactacctcggatcaattgcaaataaataaaatgaaggcatccccttttgatgtgatggcatatgcaaagagatggaaaagaaaggtacaccgtaatcctgagagcaacaaagtagaattcatttcagggcaatttaaacctaaaaatccttataatttcaacactgttgttcaggaattcgtaggtgcaaactcggatgtttttaaagtaacaacggaagacaccatacaggtaatgaaagaagaaatgactcctttgggagattatgtaattcgtacccagcagttcttcagaggagtgcccgtatatggttcgacacaagtattaaacttaaatcaaaaaggagtggtaacagcatggtccggagggattgtttcagaactgaacaagcaagaaaacctaaataaagcaaagaatcttagtcaacaggcagcgattcaaaaagccgaacatgacctaggttttatccctgagtattatattccaccggctgtcgaactcgtaatttacatgaaagaagagattgcgcattacgcttaccatgtaaatctaaattttctgaatccacaaccgggaaattgggattactttatagatgcaaatgatggaaccattttaaataaagtcaatcgtatccatcaagtgcaagtggcgcgaaatatggtcgattctaaccaaattggatttggaataggagtgcatggagataaaaaacaagtaaatacagtattttctaattcgtattactatttgcaagataatactagaggtaagggcatttatacatacgatgccaaaaattcaaaccggctcccgggcacgctatggagaaacgcggataatcagtttactgcaaagtatgatggtcccgctgtagacgcacattattacgcaggagttgtatacgattactacaaaaataagtttaatcgtaacagctatgatggagcaggagcgccaataaaatcaactgttcattatgggaaatcgtatacgaacgcgttttggaattcctatcaaatggtttatggagatggggacgggtctacctatccattctcaggagcattggatgtagtaggacatgagttgacgcatgctgtaacggaaaaaacggcaaatttaatttacgaaaatgagtctggtgctttaaatgaagcaatgtccgatatttttgggacattaattgagtactacaataatcagaatcctgattgggaaatgggtgaggacttaagttttaatagacagggatttcgttcattagctgatccgacaaaatatggtgatccggaccattattccaaaagataccgtggttcaaaccaaagctatttagttcatacaaacagcggaattataaacaaggctgcttatcttatcagtgaaggcggaacccactatggcgttaccgtgaatggaatcggcaaagagaaactgggaaatattttttacagggcattaacacagtatcttacagagtcagctacatttagccaaatgagggcagcagctttacaagccgcgacggatttatatggagcagcaagtgctgaagttataagcgtgggcaaagcttttgatgcagtaggagtcaattctatagacttgtcctaa

SEQ ID NO: 142 - protein, 584 aa, Unknown
  Obtained from an environmental sample.
  SIGNAL (1)...(25)
MKKKVVLLGLSMGLLSNPAIGTVWAEGAANPVFFQNENEESTTFTSTTSDQLQINKMKASPFDVMAYAKRWKRKVHRNPESNKVEFISGQFKPKNPYNFNTVVQEFVGANSDVFKVTTEDTIQVMKEEMTPLGDYVIRTQQFFRGVPVYGSTQVLNLNQKGVVTAWSGGIVSELNKQENLNKAKNLSQQAAIQKAEHDLGFIPEYYIPPAVELVIYMKEEIAHYAYHVNLNFLNPQPGNWDYFIDANDGTILNKVNRIHQVQVARNMVDSNQIGFGIGVHGDKKQVNTVFSNSYYYLQDNTRGKGIYTYDAKNSNRLPGTLWRNADNQFTAKYDGPAVDAHYYAGVVYDYYKNKFNRNSYDGAGAPIKSTVHYGKSYTNAFWNSYQMVYGDGDGSTYPFSGALDVVGHELTHAVTEKTANLIYENESGALNEAMSDIFGTLIEYYNNQNPDWEMGEDLSFNRQGFRSLADPTKYGDPDHYSKRYRGSNQSYLVHTNSGIINKAAYLISEGGTHYGVTVNGIGKEKLGNIFYRALTQYLTESATFSQMRAAALQAATDLYGAASAEVISVGKAFDAVGVNSIDLS

SEQ ID NO: 143 - DNA, 2541 bp, Unknown
  Obtained from an environmental sample.
gtgaacacccccccaccccgccgacggccacgcacaccgctggccgccctcggcctcagcctcggcctgatcctccagccgctcgccgcgtcgcccgcgagcgcggccaccgacccgccgccgcccccggccgcccagttcctcgcgacccgcgacccggcgcacgtccagaagtcccgcgtccccgtacgcgaccggcccccgctacccgcctccacggacgcgctgcggcgtgactacgacgagtcggcgcaggcgcagccgcggacgcacccgcggccgtcggcggaacgcgcggccaccgcggcggcggccgcttgcgacgtcaccgacttcaccacccgctcgggcagcgagctggtacgagcgatcacttcctcgaccaccgactgcgtcaacacgctgttcaccttgaccggcaccgacgcgaacgccgcattccgcgagtcgcagatgacgacggtggcgtacgcgctgcgcgacaacgcccgcgcctacccgggagacaacagcaccggcaccgcccagctcgtgctctacctgcgcgccgggtactacgtgcagtggtaccacccctccgacgtgggctcctacgggccggcgctgaagaccgcgatccagtcggggctggacgccttcttcggcaacgcgcgggccttcacggtcgccgacgccaacggcgaggtgctctccgaggccgtcaccctgatcgacagcgcccaagagaacgaccgctacctgtccgtcgtcaagcggctgctcaacgactacaacgccacctacgacgcctcgtggtggatgctgaacgcggtgaacaacgtcttcaccgtgctgttccgcgcgcaccaggtgccggcgttcgtcacggcggtcgaggcggaccgcagcgtgctcgagacgctgaggtccttcgcggtgaaccacctcgacctgctcggcaccaagaacgccttcctcaccgccaacgcggggcgcgagctcggccgcttcctccagcacgacagcctgcgcggcgccgtccggccgctggccaaggatctgctcgggcgcagctccatgaccggcccgacggcccggctctgggtcggcgtggccgagatggccgacgcctatgacaaggccaactgctcctactacggcacctgcgatctcagccgccgcctgcaggacgtcgtcctgcccgtcagccacacctgcagcgccagcatcaagatccgcgcccaggagatgaccgccgagcaactcgcggactcctgcgccagcctcgccggccaggacgccttcttccacgacatcgccaaggacggcgaccgcccggtggcggacgacaacaacaccaccctggaggtggtcgtcttcgactccagctcggactaccagaccttcgccggcgtgatattcggcatcgacacgaacaacggcggcatgtacctggagggcgaccccgcgaaggccagtaaccagccgcggttcatcgcgtacgaggcggagtgggtacgcccgcggttcgagatctggaacctcaaccacgagtacacgcactaccttgacggccggttcgacatgtacggcgacttcgaggcggggatgaccacgccgaccgtctggtgggtcgagggcttcgccgaatacgtctcgtactcatacaggaagctgacctacgaggccgcggtcgcggaggcggccaagaagacctacgcgctgcgcacgctgttcgacaccgcctattcgcacgacaccacccgcatctaccgctggggttatctgggggtgcggtacatgctcgaacggcaccccgacgacatcgcgaccctcctcgggcactaccggaccggcgcgtgggacgccgcccgcaccctgctcaccggcacgatcggcagccgctacgacgccgactggcagacctggctggccgcctgcgcctccggcgcctgctcggacggcggggccaacaagccgcccgcggcgagcttcactgtcacggcgaacgcgctcagcgcccagttcaccgacacctccgccgatccggacggcagggtcgtctcgcgccggtgggacttcggcgacggcggctcatcgaccgaggcgaacccgtcgcacgtctacacctcgggcgggacgtacacggtgacgctcacggccaccgacgacgacggcgcgactggcaccgccacccggcaggtcaccgtgtcggcgggcggcggctccctgcccgagtgcagcagcgccgacacccggcagctcgacaagaactgcaagcgcggcaacgtgtccgccatgtccgggaactacgcgtacttctacatcctcatccccgagggcgtccgcaggctgaccgtcacctcgtcgggcgggaccggcaacgcggacctctactactactggaagcagtgggcgaccaccaccgcccacaactaccggtccaccaccgccggcaacgaggaaacgctggtcatcgactatccgccggccggttacaactacatcagcctgcacgccgtcgaggacttctccggcgtcaccgtcaccacgcagtactga

SEQ ID NO: 144 - protein, 846 aa, Unknown
  Obtained from an environmental sample.
  SIGNAL (1)...(35)
MNTPPPRRRPRTPLAALGLSLGLILQPLAASPASAATDPPPPPAAQFLATRDPAHVQKSRVPVRDRPPLPASTDALRRDYDESAQAQPRTHPRPSAERAATAAAAACDVTDFTTRSGSELVRAITSSTTDCVNTLFTLTGTDANAAFRESQMTTVAYALRDNARAYPGDNSTGTAQLVLYLRAGYYVQWYHPSDVGSYGPALKTAIQSGLDAFFGNARAFTVADANGEVLSEAVTLIDSAQENDRYLSVVKRLLNDYNATYDASWWMLNAVNNVFTVLFRAHQVPAFVTAVEADRSVLETLRSFAVNHLDLLGTKNAFLTANAGRELGRFLQHDSLRGAVRPLAKDLLGRSSMTGPTARLWVGVAEMADAYDKANCSYYGTCDLSRRLQDVVLPVSHTCSASIKIRAQEMTAEQLADSCASLAGQDAFFHDIAKDGDRPVADDNNTTLEVVVFDSSSDYQTFAGVIFGIDTNNGGMYLEGDPAKASNQPRFIAYEAEWVRPRFEIWNLNHEYTHYLDGRFDMYGDFEAGMTTPTVWWVEGFAEYVSYSYRKLTYEAAVAEAAKKTYALRTLFDTAYSHDTTRIYRWGYLGVRYMLERHPDDIATLLGHYRTGAWDAARTLLTGTIGSRYDADWQTWLAACASGACSDGGANKPPAASFTVTANALSAQFTDTSADPDGRVVSRRWDFGDGGSSTEANPSHVYTSGGTYTVTLTATDDDGATGTATRQVTVSAGGGSLPECSSADTRQLDKNCKRGNVSAMSGNYAYFYILIPEGVRRLTVTSSGGTGNADLYYYWKQWATTTAHNYRSTTAGNEETLVIDYPPAGYNYISLHAVEDFSGVTVTTQY

SEQ ID NO: 145 - DNA, 4772 bp, Unknown
  Obtained from an environmental sample.
tccaaagaattgcggtcggatcacctcttcgtacatggcagtaccacggcgggcgaattcttccttgctgtagcgggggcccgtgttcatgatgcgatcctcctgttggcattattccgtgatggggctccagacgcaacccctcaggtacggttctctttcgatgaactgcattctgatgtcgcgtggtctgcggctcggcaggagcctcgccctcccaccgctcatttccgcgtgggttgccttgcacgacgctcgttaatcgtgcaactcggacacgataaataatcgtgtcccacgaacgccaactcacccctgaatgctttccagcaattcgcggcgggcgacgaggcgttggccgcgttgttcgtcaatctccagggcggcgaggatgttcttgcggacggtggtgcggacgtcttccacggcgctggcagcggtactatcgagcggaatggcgccgccggcgcggcggtcgtgaccaccggctttgcccatgccggcgacgacttgttgcagaatctcgccggcccggcccttcgcatgcacggtgcgcagcgacatgatcaggttgttctcgtaaacgccacagacaaacgcccacgccacctcttcaaagcggatgaggaagtcggcgatttcggcggcagattcgggctgcgccaggtcgcctgcccatgacatgatgagatgatcgtagatgaacgagttctgcagtgcctggatcagcgtctcgaagtacgagatgggcagccgggccgatttgatctcggcaagcaggtccttgctggcgtactggtacaggtagagcagggcaccatcatcctggggcgtggcttctcgcgggtagccggtcatctccgattcgatgccgtagaagagggcggtggcgatgtcttcgggcgggtcgagcttctgctccatcaaatacttggcgacgagggtgcaagtggccccgaggccggcgcggacatcaacgaagggcacacccttggtggtgccactgaactcatggtgatcgatgatggcggcgacttcaacgtcttcggggatggtgtgtcgtccggtgccgggttggctgtccaccatgacaacggcgtgattctctttccacgtcacctcttcgatggtcttgagttcgaggcccaggcagcggaccatcgcctggttttcggcgcggccgatgaagccatcgcgggtgaggatgctgttcttcttcagtttctttttgaagaggtgagcgaggcccatcatgctgcccagactgtcggggtcggggttcacatgggaaacgagaatgatgcccttgtactcctggaggtgttccaggagtttgtgcgaggaggaagacccgccggggtcggaatcgccgttgcgtgtggagggcttgccagcggccgagttcgccgccatagtcttgtcctttccctgccggcgtgacgagtctgtcacagggggaccggtcaggtgtcgcgttgcagggggtggcacggtcaggagaccggccacagcgctggggtcagaaaccggccacagtgctttactatcccttcgacagcgaaatcactcgctgccactgcttcgcggtaacaggcatgatagacaagcgaggcacccgcgccaattgccaatctttcagagcctcatcggccttcaccatactgagtggcacgggcttggggagcaggcgaattggcttgacaaggacggtgacttcgtctccgtcgatggcatcgttggcggcctgcatgatgccgacgatggctttctccttgccggtgtggtagaagaagatctcatcgccttgtttcacctggcggaggttcttgagggcggcagcattggcgatgccgctccaggtggtttggccatcctgctggagttgggcgaagttgtaggaggagggttcttccttgaagagccagcggggcatggggtgggcctttggaggtgatggtgggggatagtgtatggtggcgggcgcatcgtggtctatgtcagttcttcaccatgatgtgaaagtgattggcatggtggatggtatcgggtatgattgagtcgagtcgattcgttgaggatgaaccatggccaagaagaagccagtagccaaagccaagcctgcgaagaagccgaagaagatcacgatcaaggatgcggcgacgcgggatgtcgtgatcatcacgaagaagaacccacatgtggacatggagttggcggaagccattttccagggcaagatcaagccactgtccgacttcaagagccagttaggttggcattaatggcgggtataacatgatgaagctgagtgatcgggacaaagggaccattgtcaatgcagccatcacgctgattgatgaactctatgtgcatctgccactcaagaaggcgatgcacgccatcaatccggtgcagcggttgaagttgctgggccagcaactggcgggcctggatgatcgagtctttcacaacgagatgctgtcgatcttcctgcgacttcgcgaccttcataccaactatatcctgccagccccgctcaatcgcacgacggcgttcctgccgtttcggcttgaggaattccacgaggcggggcaacggaaatatgtggtcaccctcactcatcaaaagttgattgccgacaccacgttcttgccgggtgtgatcgtcacgcactggaacggcgtaccgattgatcgggtggtggatgtgaacgcggatcgtgaagcggggagcaatccggcagctcgacacgctcgcggtctggcctcgctgacgatccgctggctgggcatgtcgctgcctcccgacgaggattgggtggatatcacctatcatgcccagaaccagcctggcactgtgatgacgagtcggtttgcctggcaggtgtttgatcaatccgcggacgacatgggggtgggccaggcgtcgcgaggcaacaaacgcagaagcaccaagtccagaagcaagcgcaccagcaaagtgaagcaggcgaagccagtccgggccgacgcgatcgacatgcgagcctgtctggggctggacatgcgaaccgaagtggaaaggcaggtagccctgcagctcttccgccggtcgcggctggatcgactgatgaacatcagcgggaaggacccgacgctgcccacggtgccggagttcgagacggtgtttccgcgcgtgggcaacgtcagcacgcccagcggcaggttcggctacatccgcatttccacgtttgatgtccgcgatgatcagcgattcattgacgagttcctgcgtctggtggcacaactggataacagcgggttgatcatcgatgttcgaggcaacggtggcgggctgatcctcgctggcgaacggctgttgcaatgcctgacgccccatacgattgacccggaaaagttgcatttcatctgcacccaggctacgcaggcaatcaccacgcttgctccgtttgcggcgtggcgagcatcgattcagcaggccacgctgaccggcgcggagttctcgcagggtttcccgctgcttccgttagcggattacaacgatctgggtcagcggtatcaggggccggtcgtgctgctgacggatgccttgtgttacagcaccacggacattttcgctgcaggcttccaggatcatgggataggtcgcgtgatcggtgtggcggagaacaccggtgcaggtggcgcgaatgtgtgggactatggtttgttgaagcgattcatgccgaaaggcagcatcgatttgcctgctctgccccaggaggctgacttccgactggccatccgtcgcacgacgcgagtgcgtgaacaatcgggagtaccactggaagatttgggggtgaagccggatgaggttcatctaaccacgttgaacgatgtcttgaacggccatactgacttgattgcgaaagccgccctttggttgaagcagcaagggacgcagtcgctcgccattgcccatgttgatgtgaagaagggtgagatcgcactgagctggagcaacattgatcgtgtcgatgtgtttctgaatgaggtgcccttttcgtcacattctccgttgaaggtggggcacgtggtcacggtgccgctgaagcgaggtgctgttgtcaagttacatgggtatcgggcaggaaatctggtggtgagtacgcgacaagtgatctgatagcagcagactggagttgggatggcagacgttgcaggtcagccgggtggctcgctgatttatatcgggatcgtagggctggtgtatggagggttctacctgctgttgcgacgcgtctggccgctggcgcttgcgcacatgctggcgaacattttgaatgaagtgctgcgcggatgattgcccggggtagcatggtgaatcattactttcctttaccccgtgactttgttgctgaggtgggcttgtgtttccgtcctcaatggtaggtgcatctcacctaatgggcatgctagaacgtcaaagaacgaagtacgacaaggcttgcattgttatcgatggttgccgttgcggtcttttccaaacctgcggcactgacttgagcatttctggcaaagcatcggaacacctcttgttgttcgcacagctttcgccgataattcagtgaacacaatgtacggcatcggctgtgctggtttaagcctgagagtattgaagcagcctcaggctttatttgtctaatggtattgtacggacaacgtacgggtttgtcagtctgttcggtcttgatttgtacggaattattccgtacaatacttgcatgaagacaa

SEQ ID NO: 146 - DNA, 2397 bp, Unknown
  Obtained from an environmental sample.
atggtggaggcgatccgcaacgtggcggcggccggcgtcgtgccggtgatggcggccggcaacgaccgcgacgacttcgggctcggcacggtcggttcgccgagcacggcgcccgacgcgatctccgtcgccgccgtcacgaacaaccacgtcttcgcggaggcgctggccgtgaccgcgccgggggccccgccggtgctgacctcgatcgccctccagggcgccggcggctccgatccgcccgccgcgtggagcgcgcgcgagcaaaccctcgtcgacgtccgctcgatcgtcggcaccgacggcaagcccgccgaccggttcctctgcgcgccgcccgggcgcgacccgaacagcgcggcgaccacgctgcccgagcggtcgctcgcgggcgcggtcgtcctcgcctggcgcgggaactgctcgttcgtgtcgaaggcggagcgcgcgaagtcggccggcgccgcggggatgatcctcgtcgacaaccgccccggggacacgtacccgatcccggtcgcggggctcgccgtgccgagcgggatggtcggcgacgtcgacggggcgcacctcggcgtattcctccaggcgaccggcggccgcacgacgttccgcgtcggtcggagcgtctcggagatcgtgaccggaagaagcggcgtcgtcgccagcttttcgtccggcgggccgacgccgttcggccaccagctgaagcccgacgtcgcggcgcccgggacgcaggtgctctcgtcgacgccgccggcggcgacgcgcacgactttctacccgctcgacgggacgagcatggccaccccgcacgtcgccggcgccgcggccctcctgctgcagcggcatccggcgtggagcccgcaggaggtgaagtcggcgctgatgtcgaccggtgtgcccgcctgggcggacagcgcgcggacccaggaggcgcccgtcctgctcgagggcggcgggctcgtcgacgtcgggcgcgccgacgaccccgggatcttcacgagcccggcctcgctctcgttcggcgacgtgaacgtgagccacggcgcgcagacggcgccgctgctcctcgcggtctccgacgccggagccggcgccggaacgtgggacgtcgagctgcggccgcagtcgacctcggccggcgcctcgctggacgtccagtcgagcctcgacctggcgcccggcggcacgctctacgtggcggtcgccgcgagcgcggccgcaggcgcggcggtcggcgacgactacggcttcctcgtgctccgccggggcgccgtcgagcgccgcatcccctacttcttctccgtcacgcgcccgcaggtcccgctcgcgccgatgctggggccgctcaagaagctgcaggcgggcgacacgcggtccggtgcgtcgctcgtccggcagtaccgctacccgacgtacccgttcgggccgccgcccggctacaccggccccggcatggacgagagcggcggcgagcacgtctacacggtgcgggtgaccgatccggccgtgaacgtcggcgtctcggtgatcgccgcaggcccgaacgcgctcgtcgacccttggatgctgagcgcgctcgacgagaacaccgtcgtcgggctggccgggacgccggtcagcgtcaacaacctggcgatcgactggcgcttcgacgtgggcgcggcggccgccgtcttcccgcgacgccagcagcagctgtacgtcgtcgtcgactcgggctccgacgagctcaccggggagccgctgcctggccagtacgtgctgaacgcgtggcagaacgacgtcgtcccgccgtccgcccggctggtgacgacgcgcgtgtccgccggccggccgctgctcgcgctgcgggcgctcgacgcgggggccggcgtcgacccgctgtcgctcgtgatcgcctacgggcgcgtgctcgtcggagcggcggcctacgaccccgtctccgggctcgcgctgttcccgctcccgcccgacgtgcccgcgctgagcaccggcacgacctccgccgagctcctcgcgtcggacttccaggaggcgaagaacgtcgacacgccgggcggggagatcctgcccaacacgaggttcgtgcagtcgcgaatccgggtcgtcgacgggccggcgctcacgtggctcgccccggccgcgggctcctgcgcggggaagagcccggagctgctcgtcacggcgggctccacgaagcgggtacggcaggtcgcgttcgcggtggacggccgtcgcgtcgcggtcgaccggacgggcccgatcggcctctactcggcgacgtggcggacggcgggcgcccggacgggtcgccacgtggtcacggcgaccgtgaccgacgcgtccggacggtccgcccgcgaccgcgcaacggttcgcgtctgcggctga

SEQ ID NO: 147 - protein, 798 aa, Unknown
  Obtained from an environmental sample.
MVEAIRNVAAAGVVPVMAAGNDRDDFGLGTVGSPSTAPDAISVAAVTNNHVFAEALAVTAPGAPPVLTSIALQGAGGSDPPAAWSAREQTLVDVRSIVGTDGKPADRFLCAPPGRDPNSAATTLPERSLAGAVVLAWRGNCSFVSKAERAKSAGAAGMILVDNRPGDTYPIPVAGLAVPSGMVGDVDGAHLGVFLQATGGRTTFRVGRSVSEIVTGRSGVVASFSSGGPTPFGHQLKPDVAAPGTQVLSSTPPAATRTTFYPLDGTSMATPHVAGAAALLLQRHPAWSPQEVKSALMSTGVPAWADSARTQEAPVLLEGGGLVDVGRADDPGIFTSPASLSFGDVNVSHGAQTAPLLLAVSDAGAGAGTWDVELRPQSTSAGASLDVQSSLDLAPGGTLYVAVAASAAAGAAVGDDYGFLVLRRGAVERRIPYFFSVTRPQVPLAPMLGPLKKLQAGDTRSGASLVRQYRYPTYPFGPPPGYTGPGMDESGGEHVYTVRVTDPAVNVGVSVIAAGPNALVDPWMLSALDENTVVGLAGTPVSVNNLAIDWRFDVGAAAAVFPRRQQQLYVVVDSGSDELTGEPLPGQYVLNAWQNDVVPPSARLVTTRVSAGRPLLALRALDAGAGVDPLSLVIAYGRVLVGAAAYDPVSGLALFPLPPDVPALSTGTTSAELLASDFQEAKNVDTPGGEILPNTRFVQSRIRVVDGPALTWLAPAAGSCAGKSPELLVTAGSTKRVRQVAFAVDGRRVAVDRTGPIGLYSATWRTAGARTGRHVVTATVTDASGRSARDRATVRVCG

SEQ ID NO: 148 - DNA, 4437 bp, Cochliobolus heterostrophus strain C4 (ATCC 48331)
  CDS (203)...(1426): Exon
actagcctccttaatcaattagacctggccggaactaccggcattataagttatacgatgttcatcattgccttaagagaccctatatagtttgcgtctgtacatacgcagacttgtcacctcctggaattctgtctcatattagcatctccgtcgcctggtactaataaagccagtttttttttaaacaccagtatccatcatggtgggaagcgtcaacaagtttctggccattgccggcactgcctcggcagccgtcttcgacctgcccgttgtcatcaagagcacatacagcagcgtcaagttcgacatcggcacgcccccgaaagaacaccagctactgttcgataccggctcgtcaaccctctggaccgttagcactgactgcacacaagactcgtgtccagaaggaagcacggagctgtataaacgacggtactacaatgcatcggcatcatccacggccgtcgatgttggcattcccgccacaattccttacttgggcggtaacgttgagggcgaaatttatcaggatgtcttcagcgctctagatgggtccgtggaatggaaccagtcattcattgcagtcaataagagctcatggctttggatcactgcagacggttttctgggccttggcttctctaccatcgcagagcctaacacgtcgacactggtcgaaacgctgctatgggatggcaagctagacaaaccccgattcggcctatactatggcacaaacctaggagacgagggccctcaggacggtgtactgagcattggcgacagtcacgaggacaagtttgttgatggccaggtggtttatgctcctctgcagaaggtcaacaacgagtatgatctatggcgcacaccgttgaaggctgtcaacctactggtcgccaagaacccgtccaacccaaaccacacagtcgagacgcacattggcaaactgcccacgacgcagttttctggcaatgccatagagtcacccaatgtgactttgtcaacgttcggcgacggcactgccattttcgacacgggagctggcggcctttccctgccagaagatatgattgattccatatactacaatctcggctgggattaccaaagtctgctcaacggcaagcagcgctttacatgcgaggccatgaacgcatcctgggccatttctctaatccttggtgaaggtgcgcccgagaacgatgtcgtagttagcattcgcggcgatgaattactcaagcctggagctcaatgtatgccaccgtttgacccttccaacgcaccttcatttgcgcttgttggcactaccttactccagaggtactacactatatgggactttggtgcggacaaggtggccgagtacaagcctcggcttggatttggtaggctcaagaagcagtttgactggaagtatcagtcataagggtcacgtagaagggggaggttttctcgccaattgtgcatgtagtacgtaaaatatcaagatgagatgcaaacaaggcacttggtgcagtggtgaacatcgtggttgcaggcgcaaaagcgtcctgtgtaacaacaatacgagcgatatgtagaccagctagtaatgccagcggaagtgagtgatatcttgcaaagtcgtcggagtgagcatgttgattgcatgtgtatttgtgtatgtacatatctatggtggtggtggtgtcaaggccaacacgagtcttcctaggttacgtcaaggaccctggcgctagttgctgacggacgcgcgcaaccactgctttctgtcctcatctcgcgtgctctgttgtctgacaaccaaacccaacaacctctcatttcgccatgatccaggctcttctccaggtacgtctagccttgcaattgctgcctttgctcctaaaactacctcccttttcattcaccactaacgcatactacagcgcctggcccgctggctcgaccggccgcaattcccatggaagcgcctggttgtcggcttctccctcgcagaatttgccctcgaaaactggcttctcttccgccagtatcgtgtcctccaacgcacctctatccccaaggctcttgacaaggaaattgaaaaggaaacgtttgacaagtctcaggtgcgcctcccctcgccgccccactgaggccagacatggcgccaatcgtgatattgaaactgacaacggctgcagcaatatggtcgcgccaaagcaaggttcagcttcatctccggtgtcttcaaccagctcaagcacctagcctctctctacttcaacctatacccgtttgtctggaccgccgccggcactgtcctcgcccgctatgcgcccgcccgcttttcgggcgagatatcgcagtcgctcttgttcatgtacatgctcggctggatcgacttggtcgccagtctcggtttctcgtactaccacagcttcgtcctggaagaaaagtttggcttcaataagatgacggtcaagctctggctcacggatatggtcaagggccaggcgctcgccattgcatttggtattccgattggaagcgccttcctggccattatcaataagacggggcagggctttttctactacctgtggatgttcatgctagttgtgcagattaccggcatgactgtctacccgatcctcattgtgcccctgttcaacaagctggagccgctcaagcccggcaaactcaaggagtcagtcgaggcacttgcttccaagctcaactttcctctttcggagctgcaggtcattgacggcagcaagcgcagtgctcacagcaatgcctacttcacgggcctaccctggattggcaagaagaagattgtcatctacgacacactgctggaaaagagcacggagaaggaggtcgaggctgtactggcacacgagctcggtcactggaagatgaaccacacgtcgcgacttctctttattagccaagcgcatctattctacatttttgcccttttctccgtcttcatcaacaaccggtcgctgtacgcagactttggcttccaccgggagcagccgaccattgttggtttcatgctcttcaacgagattctgtcgcccacggactcgatcgtcaagcttctccttaacatctggacccgcagcatggagtacgaagcaggtacgtggctcaaatgcttgcgtgtttgtgtatttgtgtgtgtgtatgatcaagactaacatgaaacagatgcttttgctgtcaaacttggatatgcgcgcgagctaggcgcatcgttaatcaagctgcagattcagaacctatcgagcatggatgccgactggttctactcgagcttccaccactcgcaccccattttgacggagcgtctcaaggctatgaaatggactggtgagaagaagattgtggttgacaaggcggccgacgaggacaaggctgtaaaggcagcggatcgggagctgtaggcgctggtgggtggtggtggtgcgtgtgagtgtgcgatgtagggcaaaaaaggccacgggcatgtggaagcaagattgggtgcggaccattggtgtagtactagcatgtagctccaatatgacggcgcaaaagtggcagtgcctctcatctcggtcggtctgtggtggcatggcaagatggctaatccgacttttttgcctttgccgcattatccctcttcctctgcaggtctcgctccttcttggccttcttcctggcatccttgtccacctgtccgtctgggggcgattgttggctatggtcatgggcctggtcctgcttcctcttcttggtgccgttgatctgcactggtggttcctgctcaccctcttgcacgacgttggtcctgttgcccacgtcgccaatctcgatgccgccttgctcggcctggtaggtggccgcgtcttgccactcttgatctgcgcctgtatttttgctgccctcgccatcagcagcagcgtccagggcctcgtcctgggcctcgagagtcgtgtcgggctcaagatactcgccgcgcaagcccgcagctacacggcgcagatggtgcatgagcaggttccccactgcgccgccctttgcgttgaacgtcacgccatcgggagtgataagggcgtcggggtgcaagtgcgcatgtgtctcggagttttgcaggtacttttccagcacggcggatgcgtcgttgagagacacgggcacgctggatacctggcggcggggcgggggtgcctcaagcagcatggttgtgcaattgtataaaagaatgagaaaagttagttatggcgcagacatcaatcttgggttgagtggtacattcagaaaagagtcttgggtatgagcatgtgcatgggcatgtaaaggtgcaactttttgcgcacggacacccaacccatgttttactattagttttggtctgcggactggagaatggggcgctgcagtcgacgaaccatttacacc

SEQ ID NO: 149 - protein, 408 aa, Cochliobolus heterostrophus strain C4 (ATCC 48331)
MVGSVNKFLAIAGTASAAVFDLPVVIKSTYSSVKFDIGTPPKEHQLLFDTGSSTLWTVSTDCTQDSCPEGSTELYKRRYYNASASSTAVDVGIPATIPYLGGNVEGEIYQDVFSALDGSVEWNQSFIAVNKSSWLWITADGFLGLGFSTIAEPNTSTLVETLLWDGKLDKPRFGLYYGTNLGDEGPQDGVLSIGDSHEDKFVDGQVVYAPLQKVNNEYDLWRTPLKAVNLLVAKNPSNPNHTVETHIGKLPTTQFSGNAIESPNVTLSTFGDGTAIFDTGAGGLSLPEDMIDSIYYNLGWDYQSLLNGKQRFTCEAMNASWAISLILGEGAPENDVVVSIRGDELLKPGAQCMPPFDPSNAPSFALVGTTLLQRYYTIWDFGADKVAEYKPRLGFGRLKKQFDWKYQS

SEQ ID NO: 150 - DNA, 1224 bp, Cochliobolus heterostrophus strain C4 (ATCC 48331)
  CDS (1)...(1224): Exon
atggtgggaagcgtcaacaagtttctggccattgccggcactgcctcggcagccgtcttcgacctgcccgttgtcatcaagagcacatacagcagcgtcaagttcgacatcggcacgcccccgaaagaacaccagctactgttcgataccggctcgtcaaccctctggaccgttagcactgactgcacacaagactcgtgtccagaaggaagcacggagctgtataaacgacggtactacaatgcatcggcatcatccacggccgtcgatgttggcattcccgccacaattccttacttgggcggtaacgttgagggcgaaatttatcaggatgtcttcagcgctctagatgggtccgtggaatggaaccagtcattcattgcagtcaataagagctcatggctttggatcactgcagacggttttctgggccttggcttctctaccatcgcagagcctaacacgtcgacactggtcgaaacgctgctatgggatggcaagctagacaaaccccgattcggcctatactatggcacaaacctaggagacgagggccctcaggacggtgtactgagcattggcgacagtcacgaggacaagtttgttgatggccaggtggtttatgctcctctgcagaaggtcaacaacgagtatgatctatggcgcacaccgttgaaggctgtcaacctactggtcgccaagaacccgtccaacccaaaccacacagtcgagacgcacattggcaaactgcccacgacgcagttttctggcaatgccatagagtcacccaatgtgactttgtcaacgttcggcgacggcactgccattttcgacacgggagctggcggcctttccctgccagaagatatgattgattccatatactacaatctcggctgggattaccaaagtctgctcaacggcaagcagcgctttacatgcgaggccatgaacgcatcctgggccatttctctaatccttggtgaaggtgcgcccgagaacgatgtcgtagttagcattcgcggcgatgaattactcaagcctggagctcaatgtatgccaccgtttgacccttccaacgcaccttcatttgcgcttgttggcactaccttactccagaggtactacactatatgggactttggtgcggacaaggtggccgagtacaagcctcggcttggatttggtaggctcaagaagcagtttgactggaagtatcagtca

SEQ ID NO: 151 - protein, 408 aa, Cochliobolus heterostrophus strain C4 (ATCC 48331); identical to SEQ ID NO: 149
  DOMAIN (5)...(389): Eukaryotic aspartyl protease

SEQ ID NO: 152 - DNA, 3002 bp, Cochliobolus heterostrophus strain C4 (ATCC 48331)
  CDS (257)...(304): Exon
  CDS (363)...(428): Exon
  CDS (588)...(725): Exon
  CDS (774)...(950): Exon
  CDS (1001)...(2290): Exon
gcttggttgccgtggcggggcttgctgaaccttttgtcgtgctactacatggtttggtccgttgttttgtttgcggtgtttatcacacaagtgcaaactttggatacttccaccggtgcctgagcagtatgtagggagattctgaaaccctctagagggcatgttcgacctacgtgatgaaagatcaagctgagtagacgttggcgggcactttgcaaacggccagttgcgcgtgttggttgctactagtcaagcaatgggccgagcaagccgtaacttgccatcataccctcgccttcctaaccaggtatagagctgggttccagttttccaacctaatatcgctagtacctatcggaatacagttagatatgtgccgcgtcgttggcagggtatgcctgaatgatgtcagcctcgcgcgctgcgcctgtaagtacttgaagaagactgcgcgcccaccgctttgtctctttcacggccattgataatcacaccttggacgtgattaacactcaatccccggcgcctcaagcccgaagcaagtcaccatgcagcttctttcaatcattgccgtgtgtggcctcacagccagtgtctctgctcggagcgctcgttccgttggcaggaaggtggaattccctcgccctcgcatcggcataccggcgcagaatgtgcaccctcataagcgccaggctactcagatcataaacactgaagcctccaagggtgcgtacacgagaaagaagagacgggaagttagctaacgtcatatagcctttgctgtgaacggcactgctggagctattcccgaagtctacttcgacattggcgagtcatacgctggtcttctccccattagcaaagctgccaatgagactcgggagctctacttttggttctttccttcggagaacccagatgctagcgacgaaatcaccatctggttgaacggtaagccaaagtcgaatactatcacaaactacgtctaacaaacgatgcaggtggtcccggctgctcttctctcgaaggatttcttcaggaaaacggacccatctcatggcaatacggcagcggcccaggtcccgtctacaacccatggaactgggcgaacctcaccaacatggtttgggtcgaacagcccgtcggcactggcttctctcagggaacgccgactgctactaatcaagaagagactgccgcggagttcctcggttttttcaagaactttgttgacacttttggtctgcagaaccgcaaagtgtacatcaccggcgagtcatacgctgggcgctacgtcccctacattgccgacgccatgctgagcaagaacgactcaacatactacgacgtcaagggcgtcatgttttacgaccccagcgtagccgaagacggcctcctaaccgacgtccctgccgtcgcctacgtcgacgaatgggccggtctcttcaacttcaaccagagcttcatggacgacatccacgcccgcgccgacgcctgcggctacaccgagtacatggaaaaatacctcactttccccccgaccagcaaattccccaccccggccaacaactccgacacagaaggctgctccctttggcaagacattttcgacgccgttatctacacaaacccctgcttcgacgtctacgcaatcgcaaccacctgccctctcctctgggaccccctcggcttccccggctccttcgactacctgcctccacgcaccgaaatctactttaaccgcagcgacgttcaggccgccatcaacgcgcccatccagccctgggccgagtgctccaacggcgtcctcgacacagatacctcgcccccgtcgtcctgggaagtcatcccccgcatcatcgacgccctcgaccgcacaatcattgcccacggcgaactcgactacgtcctgctgcacaacggcaccctgatggccatccagaacatgacgtggggcggccttcagggcttccagaacccgcccactgatgacttctacgtcccctaccacgacgatctgagcctgacgagtctgagcgcaaagggattgatgggcaagacgattaccgagcgcaagcttacgtttgtgcagcaggcgatgagtgggcacatggtgccgcagtaccagcccagcagtgcgtacaggcagttggagtttttgctcggcagggtcgagagtctgacatcgagagagggttttacgacgctgccgaagagtgcgcagagtaatggcacgagtattggagagaagagggatttgggtgttatgagggagtttaagaggtgggtttgagcgagctttatctacttctttctctatagaaggaaaagaaaaaaaagaaggagattgagtaatgttgtcgtaatgtcgatatgtaagataatgaaaaaacaaaacatacgtgcaaatcatcccgccacattctcgacttctttcttgccatccatcgccaacatcccctcctgcctctccttcactgcctctggcacctccgcaaacatcttgccgatagcctccaccgtcgtgttccccccgctaaagacaacaccaacattccatccctcctccccagcctccctctgcaccaatgccctaaactcctcgttaaacagcacaaccgcgagcccaacgaccgcagagggctctacaaaacacttcatcctctcaagaaccaggcgcattgccttcttaatctggtcttcagtcaccgcaaacaagcccgccacatactctggcttcgagatgatactccaggtgtgctctccaagcggcgtacgcaagccatctgcaatcgtaagcgtcttgacagatgtgacgcgctcacccgcggcaacacccctgcgtgcatcgtcaccgccctggaaactcggttccgcgccgaacacgcggatgcccgtgccgtgcagtgctgttgcgatgccgctgagcatgccgccgccgccacagggtgcgataaccgcatcgagtttaccgttcccagacccagactgagcaaggagct

SEQ ID NO: 153 - protein, 16 aa, Cochliobolus heterostrophus strain C4 (ATCC 48331)
MGRASRNLPSYPRLPN

SEQ ID NO: 154 - protein, 22 aa, Cochliobolus heterostrophus strain C4 (ATCC 48331)
QLDMCRVVGRVCLNDVSLARCA

SEQ ID NO: 155 - protein, 46 aa, Cochliobolus heterostrophus strain C4 (ATCC 48331)
ASVSARSARSVGRKVEFPRPRIGIPAQNVHPHKRQATQIINTEASK

SEQ ID NO: 156 - protein, 59 aa, Cochliobolus heterostrophus strain C4 (ATCC 48331)
AFAVNGTAGAIPEVYFDIGESYAGLLPISKAANETRELYFWFFPSENPDASDEITIWLN

SEQ ID NO: 157 - protein, 430 aa, Cochliobolus heterostrophus strain C4 (ATCC 48331)
GGPGCSSLEGFLQENGPISWQYGSGPGPVYNPWNWANLTNMVWVEQPVGTGFSQGTPTATNQEETAAEFLGFFKNFVDTFGLQNRKVYITGESYAGRYVPYIADAMLSKNDSTYYDVKGVMFYDPSVAEDGLLTDVPAVAYVDEWAGLFNFNQSFMDDIHARADACGYTEYMEKYLTFPPTSKFPTPANNSDTEGCSLWQDIFDAVIYTNPCFDVYAIATTCPLLWDPLGFPGSFDYLPPRTEIYFNRSDVQAAINAPIQPWAECSNGVLDTDTSPPSSWEVIPRIIDALDRTIIAHGELDYVLLHNGTLMAIQNMTWGGLQGFQNPPTDDFYVPYHDDLSLTSLSAKGLMGKTITERKLTFVQQAMSGHMVPQYQPSSAYRQLEFLLGRVESLTSREGFTTLPKSAQSNGTSIGEKRDLGVMREFKRWV

SEQ ID NO: 158 - DNA, 1719 bp, Cochliobolus heterostrophus strain C4 (ATCC 48331)
  CDS (1)...(1719)
atgggccgagcaagccgtaacttgccatcataccctcgccttcctaaccagttagatatgtgccgcgtcgttggcagggtatgcctgaatgatgtcagcctcgcgcgctgcgccgccagtgtctctgctcggagcgctcgttccgttggcaggaaggtggaattccctcgccctcgcatcggcataccggcgcagaatgtgcaccctcataagcgccaggctactcagatcataaacactgaagcctccaaggcctttgctgtgaacggcactgctggagctattcccgaagtctacttcgacattggcgagtcatacgctggtcttctccccattagcaaagctgccaatgagactcgggagctctacttttggttctttccttcggagaacccagatgctagcgacgaaatcaccatctggttgaacggtggtcccggctgctcttctctcgaaggatttcttcaggaaaacggacccatctcatggcaatacggcagcggcccaggtcccgtctacaacccatggaactgggcgaacctcaccaacatggtttgggtcgaacagcccgtcggcactggcttctctcagggaacgccgactgctactaatcaagaagagactgccgcggagttcctcggttttttcaagaactttgttgacacttttggtctgcagaaccgcaaagtgtacatcaccggcgagtcatacgctgggcgctacgtcccctacattgccgacgccatgctgagcaagaacgactcaacatactacgacgtcaagggcgtcatgttttacgaccccagcgtagccgaagacggcctcctaaccgacgtccctgccgtcgcctacgtcgacgaatgggccggtctcttcaacttcaaccagagcttcatggacgacatccacgcccgcgccgacgcctgcggctacaccgagtacatggaaaaatacctcactttccccccgaccagcaaattccccaccccggccaacaactccgacacagaaggctgctccctttggcaagacattttcgacgccgttatctacacaaacccctgcttcgacgtctacgcaatcgcaaccacctgccctctcctctgggaccccctcggcttccccggctccttcgactacctgcctccacgcaccgaaatctactttaaccgcagcgacgttcaggccgccatcaacgcgcccatccagccctgggccgagtgctccaacggcgtcctcgacacagatacctcgcccccgtcgtcctgggaagtcatcccccgcatcatcgacgccctcgaccgcacaatcattgcccacggcgaactcgactacgtcctgctgcacaacggcaccctgatggccatccagaacatgacgtggggcggccttcagggcttccagaacccgcccactgatgacttctacgtcccctaccacgacgatctgagcctgacgagtctgagcgcaaagggattgatgggcaagacgattaccgagcgcaagcttacgtttgtgcagcaggcgatgagtgggcacatggtgccgcagtaccagcccagcagtgcgtacaggcagttggagtttttgctcggcagggtcgagagtctgacatcgagagagggttttacgacgctgccgaagagtgcgcagagtaatggcacgagtattggagagaagagggatttgggtgttatgagggagtttaagaggtgggtt

SEQ ID NO: 159 - protein, 573 aa, Cochliobolus heterostrophus strain C4 (ATCC 48331)
  DOMAIN (96)...(532): Serine carboxypeptidase
MGRASRNLPSYPRLPNQLDMCRVVGRVCLNDVSLARCAASVSARSARSVGRKVEFPRPRIGIPAQNVHPHKRQATQIINTEASKAFAVNGTAGAIPEVYFDIGESYAGLLPISKAANETRELYFWFFPSENPDASDEITIWLNGGPGCSSLEGFLQENGPISWQYGSGPGPVYNPWNWANLTNMVWVEQPVGTGFSQGTPTATNQEETAAEFLGFFKNFVDTFGLQNRKVYITGESYAGRYVPYIADAMLSKNDSTYYDVKGVMFYDPSVAEDGLLTDVPAVAYVDEWAGLFNFNQSFMDDIHARADACGYTEYMEKYLTFPPTSKFPTPANNSDTEGCSLWQDIFDAVIYTNPCFDVYAIATTCPLLWDPLGFPGSFDYLPPRTEIYFNRSDVQAAINAPIQPWAECSNGVLDTDTSPPSSWEVIPRIIDALDRTIIAHGELDYVLLHNGTLMAIQNMTWGGLQGFQNPPTDDFYVPYHDDLSLTSLSAKGLMGKTITERKLTFVQQAMSGHMVPQYQPSSAYRQLEFLLGRVESLTSREGFTTLPKSAQSNGTSIGEKRDLGVMREFKRWV

SEQ ID NO: 160 - DNA, 3407 bp, Cochliobolus heterostrophus strain C4 (ATCC 48331)
  CDS (1001)...(1156): Exon
  CDS (1277)...(2023): Exon
  CDS (2177)...(2407): Exon
  misc_feature (1)...(3407): n = A,T,C or G
actcgtatcgtttctgttcattgttcaccttgtcgggccccagaaccaagtgtggtttagcatagcgcaggtttggtggcatttatattgcgtcaagatgtatagacggatagtcttttgtcacttatacccacttttattcatttgcatgtagcgcgggagtttgctgatgaaagagaaaggtttttttgtcttgttattttcttgtcgtgacgaaagttttttgttacctcactccaaaaagactatcatgtttgaaattatcatgttgagagaaaattcacatgttgcaggtaggcaggcatatggtggcttacatactatactagagcacaaaaaaagaaggatagtaagcgaaatattcaagttgaaaggtcatgttacgataactccccccttggacttattacctattagtcactcagtcaagcttcttcccttttcctccaccttcttcttcctcccccttcccgtcagcaaaacaatatgaatgtactttgatttacccactttcgggtcctctcgcccgccatcatcttttctttgtacgtcagacctgcctcttgtggtacacatgcgtcacggtacaccatgccggattaggaaagcgacaagatggatatgcggtacccaagacttgcttggcgggttatcctggatccccgcgcagcatgtttattggctaagatggctggtgaagctataataggcatgatgcggatgctgaaaacatgtgtgtttatgtatcttttttttgggtgagtggaccgggtattgttggctttgtggggattgtggacggggatggggtgggtaacggtgaggtgaggggggttactatagtataaattggagttgattattttgcttcttgtttgatttcttttacttcacttctctctatcctcgcttctttttctcgccttttgtaagaaacaaggccgccgtgttttttttctcagtcaagatttcaaaagggacaaaggaaagagaggacaagatgaagtcgcttggtcttctcgcaactgtttgcgctactgctgcgctggccaagggacccgagcgagttagcaatgcggcgaggagtattacgattgaagttgcgccgggggagacgcgccagattactgaggatgagaggtgggatattgctactgtgagtttgtggtggttgttgaaacacttgtctattatccctccctttcttccccacggaaacacctttttttttaaactacagctcctttcgttttatttttactaactataacaccagggcggcggttgtggaagccacttcttcgacattacggattcgttcgccgaacccatagccgtcacgcgcgcggccgcctacccatccaccttccaatacagcaccaacatccggcgcctcttcccctcgctcagctgggccaacatcaagaaaaacctcgagcaatactcgaccttccacacgcgcttctcagaaacccaatctggcgccgacgctgcccagtggctcctcgcccaagtccaagccgtggtcaagcaagccaacaaatcgggcgtcacagcctctgccttcccccactcgctctggccgcaaaactcaatcatagcccgcatccaaggccgctccaaccgcactgtcgtcgtaggcgcccacctcgactccatcaactcggccaaccgcctcaccggccgcgccccgggcgtcgacgacgacggcagcggctccatgcttcttctcgaggccctgcgcgtgctgctcaccgactcggcctttgcaggctccaacaaccttctcgagaacacgattgagttccactggtatgccgctgaagagggcggtctccgcgggagccaagacatcttcacgcagtacaagaacgcaggaagagagatctgggctatgctgcagcaggatatggtggggtacacaaaggggacgctggatgcgggcaagcccgagagttttgggctgattacggattttacggatgccgtcttgaatcagtatttggtaaaagtgattggtgaggtatgtaaattttttggtttccttttccccttcctctnnnnnnnnnnnnnnnnnnnnccccccccccccccctccgttagaccttttcccctctttttgctgcaaagggagggagacaagaaagaagaatacacaatgctgatgttgatccagtacaccgatatcacctatgtcaacagcacgtgcggttatgcatgctcagaccacggttccgccatgcgcagtggataccctgcctcgtttgtctttgagtctgacttccggtaccgcaatccgtatatccatactccgaacgataccatggagcacatggaccctaaccacgtgttgcaacatggacgcttggtgctgggctatttgtatgaacttgggtttagcaaggcctaagggggttctttacaaatgggctctcacaatgtagttgtgcgcgggttgttgtgtaaatgtgaatatggatatgacattttcttttgatgggttatgtacacatatacgaaaaaattcagatatgattttgtctcttgtattgtttgccttgcatctcaaagaccacgcctgttacttgttccagtggctcagcaaaaggagttgaattctacgtcgggtgcgtcgtcatactatgcccctgcgtgttcagccataccaatccttattttagtaagaggacatgaaaagaaagtgtatgacgagaaaacttggtgagacaaggctcatttgaattttgacatcgtgaggcacgctgagcaaatgaacttggataatggattaacgtctgacacgaagcaagattaacaatctgtagatcaagtcaaagatgaaaaaaaaagtctcaaaactccagagattactcttctttcgtcaaatggcattcacatatacaaaaccattatgtacaaatatacaataatgaagcgtaagacttcaacatactgcatttctcctccatctacatactatctgctcagtatattgatccaccatttccaacaaccgctcgtactatactatccccaccagataacatccctagtactcggccagtctcaacctcctcccaatgtttctgcgaatcacgtcgcgctcgacgggttcgacttgtgctcggttggcattgagcgcctgacggagcatacccgcgtcgaagaagccatctatacacaagaagagcaataatcagtataatgaaatctttgaaaaaagaaatgtgagtatgtgtggggagggggggaggggggggtaaagaaaacgtgaggtaataaagtcttgggcacaaatcttgcaggatagatggaaacgctaaattgcagaaatctggaaatgaaagagaaacaggatatcaagaagaatagaaaattggcttctttttggctgcagatgctccctg

SEQ ID NO: 161 - protein, 52 aa, Cochliobolus heterostrophus strain C4 (ATCC 48331)
MKSLGLLATVCATAALAKGPERVSNAARSITIEVAPGETRQITEDERWDIAT

SEQ ID NO: 162 - protein, 249 aa, Cochliobolus heterostrophus strain C4 (ATCC 48331)
GGGCGSHFFDITDSFAEPIAVTRAAAYPSTFQYSTNIRRLFPSLSWANIKKNLEQYSTFHTRFSETQSGADAAQWLLAQVQAVVKQANKSGVTASAFPHSLWPQNSIIARIQGRSNRTVVVGAHLDSINSANRLTGRAPGVDDDGSGSMLLLEALRVLLTDSAFAGSNNLLENTIEFHWYAAEEGGLRGSQDIFTQYKNAGREIWAMLQQDMVGYTKGTLDAGKPESFGLITDFTDAVLNQYLVKVIGE

SEQ ID NO: 163 - protein, 77 aa, Cochliobolus heterostrophus strain C4 (ATCC 48331)
YTDITYVNSTCGYACSDHGSAMRSGYPASFVFESDFRYRNPYIHTPNDTMEHMDPNHVLQHGRLVLGYLYELGFSKA

SEQ ID NO: 164 - DNA, 1134 bp, Cochliobolus heterostrophus strain C4 (ATCC 48331)
  CDS (1)...(1134)
atgaagtcgcttggtcttctcgcaactgtttgcgctactgctgcgctggccaagggacccgagcgagttagcaatgcggcgaggagtattacgattgaagttgcgccgggggagacgcgccagattactgaggatgagaggtgggatattgctactggcggcggttgtggaagccacttcttcgacattacggattcgttcgccgaacccatagccgtcacgcgcgcggccgcctacccatccaccttccaatacagcaccaacatccggcgcctcttcccctcgctcagctgggccaacatcaagaaaaacctcgagcaatactcgaccttccacacgcgcttctcagaaacccaatctggcgccgacgctgcccagtggctcctcgcccaagtccaagccgtggtcaagcaagccaacaaatcgggcgtcacagcctctgccttcccccactcgctctggccgcaaaactcaatcatagcccgcatccaaggccgctccaaccgcactgtcgtcgtaggcgcccacctcgactccatcaactcggccaaccgcctcaccggccgcgccccgggcgtcgacgacgacggcagcggctccatgcttcttctcgaggccctgcgcgtgctgctcaccgactcggcctttgcaggctccaacaaccttctcgagaacacgattgagttccactggtatgccgctgaagagggcggtctccgcgggagccaagacatcttcacgcagtacaagaacgcaggaagagagatctgggctatgctgcagcaggatatggtggggtacacaaaggggacgctggatgcgggcaagcccgagagttttgggctgattacggattttacggatgccgtcttgaatcagtatttggtaaaagtgattggtgagtacaccgatatcacctatgtcaacagcacgtgcggttatgcatgctcagaccacggttccgccatgcgcagtggataccctgcctcgtttgtctttgagtctgacttccggtaccgcaatccgtatatccatactccgaacgataccatggagcacatggaccctaaccacgtgttgcaacatggacgcttggtgctgggctatttgtatgaacttgggtttagcaaggcc

SEQ ID NO: 165 - protein, 378 aa, Cochliobolus heterostrophus strain C4 (ATCC 48331)
  SIGNAL (1)...(17)
  DOMAIN (128)...(378): Peptidase family M28
MKSLGLLATVCATAALAKGPERVSNAARSITIEVAPGETRQITEDERWDIATGGGCGSHFFDITDSFAEPIAVTRAAAYPSTFQYSTNIRRLFPSLSWANIKKNLEQYSTFHTRFSETQSGADAAQWLLAQVQAVVKQANKSGVTASAFPHSLWPQNSIIARIQGRSNRTVVVGAHLDSINSANRLTGRAPGVDDDGSGSMLLLEALRVLLTDSAFAGSNNLLENTIEFHWYAAEEGGLRGSQDIFTQYKNAGREIWAMLQQDMVGYTKGTLDAGKPESFGLITDFTDAVLNQYLVKVIGEYTDITYVNSTCGYACSDHGSAMRSGYPASFVFESDFRYRNPYIHTPNDTMEHMDPNHVLQHGRLVLGYLYELGFSKA

SEQ ID NO: 166 - DNA, 4437 bp, Cochliobolus heterostrophus strain C4 (ATCC 48331); identical to SEQ ID NO: 148
  CDS (1834)...(1854): Exon
  CDS (1932)...(2114): Exon
  CDS (2190)...(3134): Exon
  CDS (3204)...(3437): Exon

SEQ ID NO: 167 - protein, 7 aa, Cochliobolus heterostrophus strain C4 (ATCC 48331)
MIQALLQ

SEQ ID NO: 168 - protein, 61 aa, Cochliobolus heterostrophus strain C4 (ATCC 48331)
RLARWLDRPQFPWKRLVVGFSLAEFALENWLLFRQYRVLQRTSIPKALDKEIEKETFDKSQ

SEQ ID NO: 169 - protein, 315 aa, Cochliobolus heterostrophus strain C4 (ATCC 48331)
QYGRAKARFSFISGVFNQLKHLASLYFNLYPFVWTAAGTVLARYAPARFSGEISQSLLFMYMLGWIDLVASLGFSYYHSFVLEEKFGFNKMTVKLWLTDMVKGQALAIAFGIPIGSAFLAIINKTGQGFFYYLWMFMLVVQITGMTVYPILIVPLFNKLEPLKPGKLKESVEALASKLNFPLSELQVIDGSKRSAHSNAYFTGLPWIGKKKIVIYDTLLEKSTEKEVEAVLAHELGHWKMNHTSRLLFISQAHLFYIFALFSVFINNRSLYADFGFHREQPTIVGFMLFNEILSPTDSIVKLLLNIWTRSMEYEA

SEQ ID NO: 170 - protein, 78 aa, Cochliobolus heterostrophus strain C4 (ATCC 48331)
DAFAVKLGYARELGASLIKLQIQNLSSMDADWFYSSFHHSHPILTERLKAMKWTGEKKIVVDKAADEDKAVKAADREL

SEQ ID NO: 171 - DNA, 1383 bp, Cochliobolus heterostrophus strain C4 (ATCC 48331)
  CDS (1)...(1383)
atgatccaggctcttctccagcgcctggcccgctggctcgaccggccgcaattcccatggaagcgcctggttgtcggcttctccctcgcagaatttgccctcgaaaactggcttctcttccgccagtatcgtgtcctccaacgcacctctatccccaaggctcttgacaaggaaattgaaaaggaaacgtttgacaagtctcagcaatatggtcgcgccaaagcaaggttcagcttcatctccggtgtcttcaaccagctcaagcacctagcctctctctacttcaacctatacccgtttgtctggaccgccgccggcactgtcctcgcccgctatgcgcccgcccgcttttcgggcgagatatcgcagtcgctcttgttcatgtacatgctcggctggatcgacttggtcgccagtctcggtttctcgtactaccacagcttcgtcctggaagaaaagtttggcttcaataagatgacggtcaagctctggctcacggatatggtcaagggccaggcgctcgccattgcatttggtattccgattggaagcgccttcctggccattatcaataagacggggcagggctttttctactacctgtggatgttcatgctagttgtgcagattaccggcatgactgtctacccgatcctcattgtgcccctgttcaacaagctggagccgctcaagcccggcaaactcaaggagtcagtcgaggcacttgcttccaagctcaactttcctctttcggagctgcaggtcattgacggcagcaagcgcagtgctcacagcaatgcctacttcacgggcctaccctggattggcaagaagaagattgtcatctacgacacactgctggaaaagagcacggagaaggaggtcgaggctgtactggcacacgagctcggtcactggaagatgaaccacacgtcgcgacttctctttattagccaagcgcatctattctacatttttgcccttttctccgtcttcatcaacaaccggtcgctgtacgcagactttggcttccaccgggagcagccgaccattgttggtttcatgctcttcaacgagattctgtcgcccacggactcgatcgtcaagcttctccttaacatctggacccgcagcatggagtacgaagcagatgcttttgctgtcaaacttggatatgcgcgcgagctaggcgcatcgttaatcaagctgcagattcagaacctatcgagcatggatgccgactggttctactcgagcttccaccactcgcaccccattttgacggagcgtctcaaggctatgaaatggactggtgagaagaagattgtggttgacaaggcggccgacgaggacaaggctgtaaaggcagcggatcgggagctg

SEQ ID NO: 172 - protein, 461 aa, Cochliobolus heterostrophus strain C4 (ATCC 48331)
  DOMAIN (239)...(439): Peptidase family M48
MIQALLQRLARWLDRPQFPWKRLVVGFSLAEFALENWLLFRQYRVLQRTSIPKALDKEIEKETFDKSQQYGRAKARFSFISGVFNQLKHLASLYFNLYPFVWTAAGTVLARYAPARFSGEISQSLLFMYMLGWIDLVASLGFSYYHSFVLEEKFGFNKMTVKLWLTDMVKGQALAIAFGIPIGSAFLAIINKTGQGFFYYLWMFMLVVQITGMTVYPILIVPLFNKLEPLKPGKLKESVEALASKLNFPLSELQVIDGSKRSAHSNAYFTGLPWIGKKKIVIYDTLLEKSTEKEVEAVLAHELGHWKMNHTSRLLFISQAHLFYIFALFSVFINNRSLYADFGFHREQPTIVGFMLFNEILSPTDSIVKLLLNIWTRSMEYEADAFAVKLGYARELGASLIKLQIQNLSSMDADWFYSSFHHSHPILTERLKAMKWTGEKKIVVDKAADEDKAVKAADREL

SEQ ID NO: 173 - DNA, 3237 bp, Cochliobolus heterostrophus strain C4 (ATCC 48331)
  CDS (1440)...(1808): Exon
  CDS (1862)...(2044): Exon
  CDS (2096)...(2211): Exon
  CDS (2263)...(2353): Exon
  CDS (2448)...(3011): Exon
tgaccttgtagaatcgttctcactggtcgttggattgtgtttggcctattattcccagtcttggtcttagctttgcgtcagccgattaatgaaataaccctaaacaaacggccagggatatgctttattcgaatccggggcgtcggcagccatgctcggcaataatccagaaaccctgtttcacaacgtgctcctatcggatagttgcgtttaatatgaggaagaaattgaggaagaaggacaagagggtggatgatgaagtatagttcttatcgtgacttggctgcgacaaagacggctaggaactgttcgattcagctgcgttttccctctatatttcattcccgtcttggatttgaagcttcgatagggagtgctagctgcttactcttatagcccagtctttccaaactgggataggaaatggaagggttattcagttggaggtctgttttatgttaattcgaggatcacgtgatgagcaaagtcaccggatctgataacagaatttagttttcaggtacaagtagatgtcgagcgacctaaggctacattctcgtagctttagatgcgcatataaccgaacacgctagtagcttcatgagttccgtttccgaaacggaacctgaattggggaaatagaacgcagaatgtagcttgcaattcgcgcaaccgaacaagctttccagccctgttttgtagatggagcggacggaaaacggatacgtaaccgaacagggccctagtagtcgtctaccgcatcaacggttgcgcatgttttcgtgggttcccgcatgtccaaccaccacagcctcaacaatggctgcattggaaatcctactttatacctttctcgctgaaagcttatattaccatgcttgcagaatttgtcattactctggttgttgcctttgtacacaagtcggcacttagtcccatgattagaccgtggcaagttgccctaacgttcactattcagcctcaataagcactcttattcagaatcacccaatgcaagaacaaagaagttggagacggacaaggagagtctcccgcaccaatgtgcgggcccatctgacattgcgaagatgcacgggttgatgacgttgccgctcttgcgcccagcaacgccatgcaatgcctagaacacaactggcaggtcagaaggctaacgacttgggatattaccggattgcttcttatccacgactatcccgtgtatccagcggacatgtataatgtcaccgtgcgcctgtagtacgtacggctgatgctggcattggttgcctgaagacggcatggttccttctccacccgggcttccatggactgcggtcttgccaagcaaacgcatagtgaaagggatataaagtgaggttcgggcaagagttataaacttccctcttacacccgccccgttggttgctcgtcaggtcatcatgaagtttgtattcaaccttgcctggctgtcgcttgctgctggcgcgactattcgcagctcgcagccagttacctacgatggctaccaggtccaccgcatccgggccattggtcaacagggcgtgatggcaaagcgtgcaatgtcgtccattcctcacgagacgctcaatgaagctcgaggttcctgggacgtgctcattgcaccagaccaactcgatgcattcagccgcctcgggctgaagtcgcgaaccctgcacaaggacttggcctactccattgctcgcgagcgtcaagtcaggaatgtttggaagaggcaatcaaacggctctgatgatgcttggtttgacagctatcacccctatgaagatgtaagtgcatgtttatcagtctcgaggaaagaatcatgctaacatcattgaagcacatcacttggtggaaggatctccaggccactttccccgagcagtcaaactggacgagtagcggaacgtcctacgagggacgcgacctgttcggtgtgcatctctggggagcaggtggccctggaaagcctgcagtcatctaccacggtactgtacatgcccgtgaatggatcgtcgctcccgttagtaaacccaaaaaggcagttctccttatcataactaacactttatagaccattgagtacatcacaaaacagctcattgatggatacaaggccggagacaacgacacaaaggcaatcttggacaaatacgacttctacatctttccctttgtgaacccggatggtaagctgcgactcactgcattgcgttgaccaattcactcacacgtgacaggtttcgtcttctcccagaccgacgaccgtctctggcgcaagaaccgccagcccccacccgccaaccaaaaccaaacctgcttcggccgcgatgtaagcactccccaacttcccccaaacttcgtattccaatttcaatctcaattctcaattccaattccagtcccactaaccatatcttgtaaagatcaaccgcaactgggaaacaaactgggacgccgacccccgcggcgcctcgccagacgcctgctcacaagtgtaccgcggcgagaaaccccgcgacgcgcccgaaaacgagagcatggacaacttcatccgcaaagtccgcgacgagcaaggcattacgctctacattgactggcacagctactcgcagctcatcctcttcccctttggccacaaagaaacgctctacgcccccgaactcggcatgtggaccaagacggcctcgctgatgagcgagtacattcgcgattcgtcaaggaacgatactacgtatctgtttggtccgagcggagcgacgctgtaccccacgacgggtgcgtcgattgatcatgtttatacgattggtagggccaagttctcgtttacaatcgagttgccggataccggtgactttgggtttgtgctgccgccagagaggatcaggcctgcgattgaggagcagtgggtgggacagcaggtcctgctggcgctcttggacgagccgttttttgacggtgtgggccctgcgattgggactagtacgtggtaaggctgctattcgtttctaagatgattgatatgatacactatgtatgtatgtagtaaatagaaagataagaaagttgagcgagaaaagagtcaggccatactgtgttgaaagttcatgcttggcttcaagcgttgatgtgaaaagtcggcttcacttggccttgcatgaaactaacgtcagtgatatgagtgagagcagccgcgccattctccatgccctcaat

SEQ ID NO: 174 - protein, 123 aa, Cochliobolus heterostrophus strain C4 (ATCC 48331)
MKFVFNLAWLSLAAGATIRSSQPVTYDGYQVHRIRAIGQQGVMAKRAMSSIPHETLNEARGSWDVLIAPDQLDAFSRLGLKSRTLHKDLAYSIARERQVRNVWKRQSNGSDDAWFDSYHPYED

SEQ ID NO: 175 - protein, 61 aa, Cochliobolus heterostrophus strain C4 (ATCC 48331)
HITWWKDLQATFPEQSNWTSSGTSYEGRDLFGVHLWGAGGPGKPAVIYHGTVHAREWIVAP

SEQ ID NO: 176 - protein, 39 aa, Cochliobolus heterostrophus strain C4 (ATCC 48331)
TIEYITKQLIDGYKAGDNDTKAILDKYDFYIFPFVNPDG

SEQ ID NO: 177 - protein, 30 aa, Cochliobolus heterostrophus strain C4 (ATCC 48331)
FVFSQTDDRLWRKNRQPPPANQNQTCFGRD

SEQ ID NO: 178 - protein, 188 aa, Cochliobolus heterostrophus strain C4 (ATCC 48331)
INRNWETNWDADPRGASPDACSQVYRGEKPRDAPENESMDNFIRKVRDEQGITLYIDWHSYSQLILFPFGHKETLYAPELGMWTKTASLMSEYIRDSSRNDTTYLFGPSGATLYPTTGASIDHVYTIGRAKFSFTIELPDTGDFGFVLPPERIRPAIEEQWVGQQVLLALLDEPFFDGVGPAIGTSTW

SEQ ID NO: 179 - DNA, 1323 bp, Cochliobolus heterostrophus strain C4 (ATCC 48331)
  CDS (1)...(1323)
atgaagtttgtattcaaccttgcctggctgtcgcttgctgctggcgcgactattcgcagctcgcagccagttacctacgatggctaccaggtccaccgcatccgggccattggtcaacagggcgtgatggcaaagcgtgcaatgtcgtccattcctcacgagacgctcaatgaagctcgaggttcctgggacgtgctcattgcaccagaccaactcgatgcattcagccgcctcgggctgaagtcgcgaaccctgcacaaggacttggcctactccattgctcgcgagcgtcaagtcaggaatgtttggaagaggcaatcaaacggctctgatgatgcttggtttgacagctatcacccctatgaagatcacatcacttggtggaaggatctccaggccactttccccgagcagtcaaactggacgagtagcggaacgtcctacgagggacgcgacctgttcggtgtgcatctctggggagcaggtggccctggaaagcctgcagtcatctaccacggtactgtacatgcccgtgaatggatcgtcgctcccaccattgagtacatcacaaaacagctcattgatggatacaaggccggagacaacgacacaaaggcaatcttggacaaatacgacttctacatctttccctttgtgaacccggatggtttcgtcttctcccagaccgacgaccgtctctggcgcaagaaccgccagcccccacccgccaaccaaaaccaaacctgcttcggccgcgatatcaaccgcaactgggaaacaaactgggacgccgacccccgcggcgcctcgccagacgcctgctcacaagtgtaccgcggcgagaaaccccgcgacgcgcccgaaaacgagagcatggacaacttcatccgcaaagtccgcgacgagcaaggcattacgctctacattgactggcacagctactcgcagctcatcctcttcccctttggccacaaagaaacgctctacgcccccgaactcggcatgtggaccaagacggcctcgctgatgagcgagtacattcgcgattcgtcaaggaacgatactacgtatctgtttggtccgagcggagcgacgctgtaccccacgacgggtgcgtcgattgatcatgtttatacgattggtagggccaagttctcgtttacaatcgagttgccggataccggtgactttgggtttgtgctgccgccagagaggatcaggcctgcgattgaggagcagtgggtgggacagcaggtcctgctggcgctcttggacgagccgttttttgacggtgtgggccctgcgattgggactagtacgtgg

SEQ ID NO: 180 - protein, 441 aa, Cochliobolus heterostrophus strain C4 (ATCC 48331)
  SIGNAL (1)...(21)
  DOMAIN (116)...(325): Zinc carboxypeptidase
MKFVFNLAWLSLAAGATIRSSQPVTYDGYQVHRIRAIGQQGVMAKRAMSSIPHETLNEARGSWDVLIAPDQLDAFSRLGLKSRTLHKDLAYSIARERQVRNVWKRQSNGSDDAWFDSYHPYEDHITWWKDLQATFPEQSNWTSSGTSYEGRDLFGVHLWGAGGPGKPAVIYHGTVHAREWIVAPTIEYITKQLIDGYKAGDNDTKAILDKYDFYIFPFVNPDGFVFSQTDDRLWRKNRQPPPANQNQTCFGRDINRNWETNWDADPRGASPDACSQVYRGEKPRDAPENESMDNFIRKVRDEQGITLYIDWHSYSQLILFPFGHKETLYAPELGMWTKTASLMSEYIRDSSRNDTTYLFGPSGATLYPTTGASIDHVYTIGRAKFSFTIELPDTGDFGFVLPPERIRPAIEEQWVGQQVLLALLDEPFFDGVGPAIGTSTW

SEQ ID NO: 181 - DNA, 3266 bp, Cochliobolus heterostrophus strain C4 (ATCC 48331)
  CDS (7)...(114): Exon
  CDS (856)...(1134): Exon
  CDS (1185)...(1337): Exon
  CDS (1442)...(1786): Exon
  CDS (1838)...(2266): Exon
gtgtgcatgtggcacgcggcggttgtgtctgcgaatggaggcgcagagggcttgggtggtgggggacgaggcacggtcagggatgtttttttggaggtggcagctgctgtcgggtaagttgcacagcgtgaggtttcagggtgggactggtgggattgacgggtcttttaggaacaaaggaaaatcgtggctggattgatttgtcgagttgattttcgatgggtggggggaacgatgttctggattattctttgttccttctatgatacgtatattgggaagcaatgatacggtatttgtgtagcgggtcaggcggttttactctgccgcagccacagataggttgtgccgcatctgcacgtgtccgttgaacttgccaatcgatatcacttgtttgtggtcatggtttacccccttttcgtgcactgtagatacctcacatgttggaagatagcttttgccgctctatctaaagcttcggactattttaatgatatcaagtcttttgcaacccaagaaggattaagagcacaaggcggtactatgaagtcttattccagcagtcccactgtcaccaacatgccacgccgttttggtccgccctgaaagaaacactgcagcagatacggcttaagacattggcccaagtaaggttgcactgcatacgtacgatcctaatacttgactctcacggactacgtgcttgagtgccagagaaactgtccccctttagtcaacagcgacccgtacaacatgtatatttatcagtagcgctgccttccaaggaggtaaatcagagcttgcaatattgttcactcccttactttgctaaaactcaacgtactgtcattcagcaaacctcgaaagattcttactgcaataatgtacttcattctgctatccttgcttgcttcacttgtaaccgctacaccattagtcaaagcacccggtagcaaggccattgccaacaagtggattgtcaaactcaaggacaacgtcgccacgatggccgctgatggcgtgaaagcagctatttccacaaagcccgattaccagtattcgatgcctggcttccgaggcttcgcaggaactctatccgacgatgaggtagcactgttgcaagcttcagatcaagtaaggcatttgcagcacaagtccgaaagcccctttgttgatttgtgtagattgagtatatccagcaagatgctgaagtttacacgacggcaattatcgaacagtcgaatgccacgtggggaatatcccgtatctcgcatacaaagccaagtgaaacggcgtatctctatgattccagtgcaggagagggaacgtgtgcgtatgtttttatctgccgccagacgttctctgtgtatcactgacgaaatgtgaagctatgtgattgatacaggagtcgatgttacgcaccccgagtttcaaggacgtaagtaatgacgctcaaatgcaagacttgcagactgacccagtaacaggcgctttattcctggcagacctcactcatgaaggtaattttatagacgggtatggtcatggaacgcacgtcgctggaacaattgggtctgccacttggggagtagcaaagaaaactaccatctttgctgtgcgagtactcgactccaatggctggggtacaaacgctgatgtgattgcgggcctggagttgatcttgcgagatgcaagagagcgtagggggacggatcagtgtcgcaatggctttgttgtcaatatcagcctgggaagtgaaaagcttccagctttgaatgatgctgtaagtagctcttgtcaagttttcttgtctgaacgctgatttagatgtaaggtcgcagctatggttgcagaggatatctttctaggagttgcagcaggtaacgatggtgtgccagctgatgacttctctccgggatccgagccttcggtctgcactgtaggagcaacggcagcgaatgatacacttgcccaatggtccaatcatggttctcggatcgacattctagctcccggcctagacatcactagcactcttcccaatggtgtggttgcctcgttttcgggtacaagtatggcagctccgcatgttgttggccttgcagcgtatttgcttggactcgggtcaccagcaaaggatctctgtggtacaatcgctgccttggcgatcaaaaatgcgatcgatcaagatacgcttccaaaaggaacaccaaacctattggcgttcaatggcgcagacgccagccagaagcgtatgaggcattcatgaagtgtttgggagacgtgaagaagtacaaggttattcggaattcgccacggcgatttgggatattccttgtgtatgtatgcaggtgtcaatatcatcgccattgccatgagcatccctccaatacgcatccctgtccgatggataattctcgaagacactagactcacagccacaatgctatattgccgatggccgcttggccataaaatacaacacaggataagtaatcagcttgcaggcccgtttttgccggtctgtctcacgtcagggcctgtcagcgacaaacggcctatcacagtccagcaataaattctccgaactccatggctgtaccaacactcatgcatacaaaccgtaactttgagacccgagccttgtcacggtgatgtcgcccaagcgattatcgccgatcgggacttccccaatcctgctggtatagcccgatcgaccaaccagcgacaatcagacaagggaattgcggggtaggggtatgcaataacaggctagtccaacctacacacgcgacttttctccaagacccaagcatcccagcttgattgcctctcatacttgatcccgctatctgttaatcattacaggcgcgtagtagctctccttcaatcacacagcactcgtcactgcggaaccaaaagtcatggcgtcatactttgatctcccgccacagaaagtggcaccatcagcgtgtatagaccagatgcctcaagaacaacggaaacagttgggccgcactagcagcctgatgtccccagccgtcgctcagatccttgaaggactaggagatgaccactcgagtagcagcgacgaagactctgacctatcagacgatcaagagaagggacatcccaagtcgcagtctaagaaggatgtcagcgcccagaagatacagcagaagaaacaaaagctcaactcagctcaagcacctcggccatcctctctctccccgaacagaagcagaagtcgctccaggtcagcaacc

SEQ ID NO: 182 - protein, 36 aa, Cochliobolus heterostrophus strain C4 (ATCC 48331)
MWHAAVVSANGGAEGLGGGGRGTVRDVFLEVAAAVG

SEQ ID NO: 183 - protein, 93 aa, Cochliobolus heterostrophus strain C4 (ATCC 48331)
KPRKILTAIMYFILLSLLASLVTATPLVKAPGSKAIANKWIVKLKDNVATMAADGVKAAISTKPDYQYSMPGFRGFAGTLSDDEVALLQASDQ

SEQ ID NO: 184 - protein, 51 aa, Cochliobolus heterostrophus strain C4 (ATCC 48331)
IEYIQQDAEVYTTAIIEQSNATWGISRISHTKPSETAYLYDSSAGEGTCAY

SEQ ID NO: 185 - protein, 115 aa, Cochliobolus heterostrophus strain C4 (ATCC 48331)
SNDAQMQDLQTDPVTGALFLADLTHEGNFIDGYGHGTHVAGTIGSATWGVAKKTTIFAVRVLDSNGWGTNADVIAGLELILRDARERRGTDQCRNGFVVNISLGSEKLPALNDAV

SEQ ID NO: 186 - protein, 143 aa, Cochliobolus heterostrophus strain C4 (ATCC 48331)
AAMVAEDIFLGVAAGNDGVPADDFSPGSEPSVCTVGATAANDTLAQWSNHGSRIDILAPGLDITSTLPNGVVASFSGTSMAAPHVVGLAAYLLGLGSPAKDLCGTIAALAIKNAIDQDTLPKGTPNLLAFNGADASQKRMRHS

SEQ ID NO: 187 - DNA, 1314 bp, Cochliobolus heterostrophus strain C4 (ATCC 48331)
  CDS (1)...(1314)
atgtggcacgcggcggttgtgtctgcgaatggaggcgcagagggcttgggtggtgggggacgaggcacggtcagggatgtttttttggaggtggcagctgctgtcgggaaacctcgaaagattcttactgcaataatgtacttcattctgctatccttgcttgcttcacttgtaaccgctacaccattagtcaaagcacccggtagcaaggccattgccaacaagtggattgtcaaactcaaggacaacgtcgccacgatggccgctgatggcgtgaaagcagctatttccacaaagcccgattaccagtattcgatgcctggcttccgaggcttcgcaggaactctatccgacgatgaggtagcactgttgcaagcttcagatcaaattgagtatatccagcaagatgctgaagtttacacgacggcaattatcgaacagtcgaatgccacgtggggaatatcccgtatctcgcatacaaagccaagtgaaacggcgtatctctatgattccagtgcaggagagggaacgtgtgcgtatagtaatgacgctcaaatgcaagacttgcagactgacccagtaacaggcgctttattcctggcagacctcactcatgaaggtaattttatagacgggtatggtcatggaacgcacgtcgctggaacaattgggtctgccacttggggagtagcaaagaaaactaccatctttgctgtgcgagtactcgactccaatggctggggtacaaacgctgatgtgattgcgggcctggagttgatcttgcgagatgcaagagagcgtagggggacggatcagtgtcgcaatggctttgttgtcaatatcagcctgggaagtgaaaagcttccagctttgaatgatgctgtagcagctatggttgcagaggatatctttctaggagttgcagcaggtaacgatggtgtgccagctgatgacttctctccgggatccgagccttcggtctgcactgtaggagcaacggcagcgaatgatacacttgcccaatggtccaatcatggttctcggatcgacattctagctcccggcctagacatcactagcactcttcccaatggtgtggttgcctcgttttcgggtacaagtatggcagctccgcatgttgttggccttgcagcgtatttgcttggactcgggtcaccagcaaaggatctctgtggtacaatcgctgccttggcgatcaaaaatgcgatcgatcaagatacgcttccaaaaggaacaccaaacctattggcgttcaatggcgcagacgccagccagaagcgtatgaggcattca

SEQ ID NO: 188 - protein, 438 aa, Cochliobolus heterostrophus strain C4 (ATCC 48331)
  DOMAIN (156)...(426): Subtilase family
  DOMAIN (74)...(142): Subtilisin N-terminal region
MWHAAVVSANGGAEGLGGGGRGTVRDVFLEVAAAVGKPRKILTAIMYFILLSLLASLVTATPLVKAPGSKAIANKWIVKLKDNVATMAADGVKAAISTKPDYQYSMPGFRGFAGTLSDDEVALLQASDQIEYIQQDAEVYTTAIIEQSNATWGISRISHTKPSETAYLYDSSAGEGTCAYSNDAQMQDLQTDPVTGALFLADLTHEGNFIDGYGHGTHVAGTIGSATWGVAKKTTIFAVRVLDSNGWGTNADVIAGLELILRDARERRGTDQCRNGFVVNISLGSEKLPALNDAVAAMVAEDIFLGVAAGNDGVPADDFSPGSEPSVCTVGATAANDTLAQWSNHGSRIDILAPGLDITSTLPNGVVASFSGTSMAAPHVVGLAAYLLGLGSPAKDLCGTIAALAIKNAIDQDTLPKGTPNLLAFNGADASQKRMRHS

SEQ ID NO: 189 - DNA, 4101 bp, Cochliobolus heterostrophus strain C4 (ATCC 48331)
  CDS (1499)...(1597): Exon
  CDS (1649)...(1967): Exon
  CDS (2005)...(3104): Exon
ttgaaacctcaattctgtcttgaatactatggtgagtcattttctgctagtcactggttttcgcagtactgatttttcgtagcttttctagtcatatcattgcatgtctctcgagatatcgatgggatcgtaaacaaaaccctatttgagcactttgaatcaatctctacttcaaaggagtggcgaaaaaagagtgatgttatgatacccaacgcaagctcgcaaaggtggagaaacagcagttaatgagctcacttagcgatgtcccattgcccagacaacggcccaaaagaaaccaggtttttctttcttctcgaccgagctggaatcatatggtattgagaatttccaagggccggccagtgtcactagctaccgaccgatttcgagttagaagcgttatccgtacttgaagtcaaaggtctcaattcaatactcagatgtaccaggagagggaacgccgaccggtagacgacaatgtcggcgactacattctagatccacggaaactgatggaagttatcatgaaaattacgctcctcgagacatttcctgttcctacatgcacggtcagaactcgtggttgcagctgtgaagaaagcaaacatattcacgtggatcgactgggcaacgcatgcataaagactccgcggaaggaagaagagattctctaccaacgcctgacttcgcgatttcgcaattgcctattagtattaggcatacgacacggtgcccagattgcgatcggagggtatacccgatgtgtgcagccatgaccgacggaaattgacaataacagaggatgttgggaggggcgagggctccacacaaaacaaccctgcatgttttcggggcgtgcaaccggaccaggaacagtatgactatgcacctggttttgcacgacgcgccatccacgtcaagcagccctcaggtacacatgatgatgtgtatcagtcacaaaagcttggtcagctcaaacctggcattgcacctgtaccacacacggcgatgaaaacacagctccagccccagcaccccacacgcgctaagatgctacaatacgtcttccagccatgaatcagccccatattgccaccaggacaaccaccaagcggcacttggcaagcttggcagtccgccgcgctgaagcttaccaaggcctcttatcacgtcttgacacggctcgtgtgcttgtttactgggtccgctcacagcggctattggtggatgaagggtcagcctcgtgtgcggatgcgcccacttggctggatgtagcaggtcgcaaagagctttgtatgtgggtttgattgtaagctgcatttcaggcatacagtgatgttggtaggagcgatatttccggtctctgggcccatttgcagctactacgagctgcaggtggtatggatttaggtaagctagtaaatagcataaattgcacagcatgccctgccaatttggaaacgacactccctttgcaaaaaagcaggcaatagtcgcaatggcatatctgaagtcaatcgcagcacttgctgcatgtgctgtagcggttgaggcagcagcccttcatcctcgcactaacaagacgctggttgattcggtacgagtatacatacattcatttcccgagttgctctaacacgcattatagcaatcgctccgtgatacgattgacattgacaacttgtatgccaaagcggagatccttcaggagattgcatacaacacaccgggaaagaaccgtgtgattggtagccagggccatgaggatactgtagaatacatcaagggccagctcgaggcattccccgactactacgatgtgtacactcaggatgtgcctctctcaatcggaaccactgccacgctccgtgcaaacaacaagacgattgaggcttttgcagtaactctggctccgggtggcaatgtaactggaccgctcgttgctattcccaacttgggttgtgaagaggtaggttcatgttttcgactatatatacccaaagaagatatcaggaagcaagactaacatggaaaaggcggatttcccagaatctctcgagggctctgtagctctgatcaagcgtggtacgtgctcgtacggcgagaaggtgcagattgctgctgccaaaggagccttgggtgtagtggcatggaacaatgccgagggcactcttgagggctactcgctccaagtcttgtatcccaagggcaagtttgtccctgtagccggcatcaccatgggccaaggagaagcgcttcttgcgcagctcaacgctggtgtcaagatcaatgtcgacatgtcaacagacgccaaggtgttcaacactcgcaacgtgattgcggagacaaaggctggcgaccacgacaacgtgatccacgtcagcggccattctgactcggtcactgctggcccaggcatcaacgacaatggatcgggcactatttccattctcgagattgctattcaactgaccaactttaccgtcaacaacgccgtgcgcttcagctggtggacagcagaggaggccggtcttctcggagccgagtactacgtgcacgagctgccccaagctgagaaggacaagatccgtcttttgctcgactttgacatgatggcctcacccaactttgcctaccaaatctatgacggtgatggttcggcattcaacctgactgggccggttggctcagccgaggctgagcacgagtttgccgcctactttgacagcattggcctcaaccacactgagattgaattcgacggccggtcagactacggcccgttccttgaggctggcatcgcttctggtggcattgccggtggagccgagggtatcaagacagaagaggaggcggccatgtttggcggaggcgccggtgttccttacgacgtcaactaccacgaggatggcgataccgtcaacaacttgaacctcgaggcgtggatcgagttcacaagggctattgcgcacatgacggccaagtatgctgtgtcgtgggacagcatcccgccaaggaacgcgacggctgcgcagaagcggtcagagaggtatgccgagtttaagcaggcgttccagaagaccaagaggtaccagaggtgggtatagattgggctcgatcccgaggcttttgagtggatgtgagcttagacacgactttaatggtgaatatcaaagaaatcttcaaggcaatgtttgtgcaagcaaaagtggatgaatgtgagaaaacgagtttgtggaattgcacgcatgtcatttgccgttttacaagatggacggtggctttactcttcgtcgtcatcgtcaactacgggtacaggctcgtccttgccggtcttgttgactttgcggtccttgtcagcaccagcaggcttggcgtcctttgctttcttcttgtcgtcctcgtcctcgtcgtcctcatcgtcgacgtcgtcagaagcggcatcctcgtcgtcttcggcgctcagctcggcctcttcctcctcgctctcatccccgtcctcgtctttgcttttggctttggtagtgcgcttggcctttttctttggcgctatgaaaaagcaaaaaaagtaagagagagttgcggagaaggggatagggaccaccaagggtttactcaagatgacttacgtggctcttcctcgtccgagtcgtctgaatcaaagtttgagccttcagactctgcgtatctggatggccgggtcagtcttgctgcaggtgtcgcatgcgcgcgcaaagggcattgtttggatgaatggggccagaggcgccatggtagctatgtcaggtgtagaggtagagtggaagtgagctgattgctgctggagggaggaaggggccggctgttgctgaccccagggctgcgactgcctttggaggcatgcgcagcgaccagacggcgtagcggtacaaactcaaaacatcaattcaaggatgcgcacacaggcgatggcaatgaagccaaaaccaccgggttgcgacgtggtgggtagaggcatgacgtcaagaaagcgtcgacttactcttcttcttcgtcgctctcgtcgctggggagggccacgagctcctcgtcgtcgttcttcctcttcctggtagtcatggc

SEQ ID NO: 190 - protein, 33 aa, Cochliobolus heterostrophus strain C4 (ATCC 48331)
MAYLKSIAALAACAVAVEAAALHPRTNKTLVDS

SEQ ID NO: 191 - protein, 106 aa, Cochliobolus heterostrophus strain C4 (ATCC 48331)
QSLRDTIDIDNLYAKAEILQEIAYNTPGKNRVIGSQGHEDTVEYIKGQLEAFPDYYDVYTQDVPLSIGTTATLRANNKTIEAFAVTLAPGGNVTGPLVAIPNLGCE

SEQ ID NO: 192 - protein, 367 aa, Cochliobolus heterostrophus strain C4 (ATCC 48331)
EISGSKTNMEKADFPESLEGSVALIKRGTCSYGEKVQIAAAKGALGVVAWNNAEGTLEGYSLQVLYPKGKFVPVAGITMGQGEALLAQLNAGVKINVDMSTDAKVFNTRNVIAETKAGDHDNVIHVSGHSDSVTAGPGINDNGSGTISILEIAIQLTNFTVNNAVRFSWWTAEEAGLLGAEYYVHELPQAEKDKIRLLLDFDMMASPNFAYQIYDGDGSAFNLTGPVGSAEAEHEFAAYFDSIGLNHTEIEFDGRSDYGPFLEAGIASGGIAGGAEGIKTEEEAAMFGGGAGVPYDVNYHEDGDTVNNLNLEAWIEFTRAIAHMTAKYAVSWDSIPPRNATAAQKRSERYAEFKQAFQKTKRYQRWV

SEQ ID NO: 193 - DNA, 1518 bp, Cochliobolus heterostrophus strain C4 (ATCC 48331)
  CDS (1)...(1518)
atggcatatctgaagtcaatcgcagcacttgctgcatgtgctgtagcggttgaggcagcagcccttcatcctcgcactaacaagacgctggttgattcgcaatcgctccgtgatacgattgacattgacaacttgtatgccaaagcggagatccttcaggagattgcatacaacacaccgggaaagaaccgtgtgattggtagccagggccatgaggatactgtagaatacatcaagggccagctcgaggcattccccgactactacgatgtgtacactcaggatgtgcctctctcaatcggaaccactgccacgctccgtgcaaacaacaagacgattgaggcttttgcagtaactctggctccgggtggcaatgtaactggaccgctcgttgctattcccaacttgggttgtgaagagatatcaggaagcaagactaacatggaaaaggcggatttcccagaatctctcgagggctctgtagctctgatcaagcgtggtacgtgctcgtacggcgagaaggtgcagattgctgctgccaaaggagccttgggtgtagtggcatggaacaatgccgagggcactcttgagggctactcgctccaagtcttgtatcccaagggcaagtttgtccctgtagccggcatcaccatgggccaaggagaagcgcttcttgcgcagctcaacgctggtgtcaagatcaatgtcgacatgtcaacagacgccaaggtgttcaacactcgcaacgtgattgcggagacaaaggctggcgaccacgacaacgtgatccacgtcagcggccattctgactcggtcactgctggcccaggcatcaacgacaatggatcgggcactatttccattctcgagattgctattcaactgaccaactttaccgtcaacaacgccgtgcgcttcagctggtggacagcagaggaggccggtcttctcggagccgagtactacgtgcacgagctgccccaagctgagaaggacaagatccgtcttttgctcgactttgacatgatggcctcacccaactttgcctaccaaatctatgacggtgatggttcggcattcaacctgactgggccggttggctcagccgaggctgagcacgagtttgccgcctactttgacagcattggcctcaaccacactgagattgaattcgacggccggtcagactacggcccgttccttgaggctggcatcgcttctggtggcattgccggtggagccgagggtatcaagacagaagaggaggcggccatgtttggcggaggcgccggtgttccttacgacgtcaactaccacgaggatggcgataccgtcaacaacttgaacctcgaggcgtggatcgagttcacaagggctattgcgcacatgacggccaagtatgctgtgtcgtgggacagcatcccgccaaggaacgcgacggctgcgcagaagcggtcagagaggtatgccgagtttaagcaggcgttccagaagaccaagaggtaccagaggtgggta

SEQ ID NO: 194 - protein, 506 aa, Cochliobolus heterostrophus strain C4 (ATCC 48331)
  SIGNAL (1)...(19)
  DOMAIN (121)...(228): PA (protease associated) domain
  DOMAIN (234)...(468): Peptidase family M28
MAYLKSIAALAACAVAVEAAALHPRTNKTLVDSQSLRDTIDIDNLYAKAEILQEIAYNTPGKNRVIGSQGHEDTVEYIKGQLEAFPDYYDVYTQDVPLSIGTTATLRANNKTIEAFAVTLAPGGNVTGPLVAIPNLGCEEISGSKTNMEKADFPESLEGSVALIKRGTCSYGEKVQIAAAKGALGVVAWNNAEGTLEGYSLQVLYPKGKFVPVAGITMGQGEALLAQLNAGVKINVDMSTDAKVFNTRNVIAETKAGDHDNVIHVSGHSDSVTAGPGINDNGSGTISILEIAIQLTNFTVNNAVRFSWWTAEEAGLLGAEYYVHELPQAEKDKIRLLLDFDMMASPNFAYQIYDGDGSAFNLTGPVGSAEAEHEFAAYFDSIGLNHTEIEFDGRSDYGPFLEAGIASGGIAGGAEGIKTEEEAAMFGGGAGVPYDVNYHEDGDTVNNLNLEAWIEFTRAIAHMTAKYAVSWDSIPPRNATAAQKRSERYAEFKQAFQKTKRYQRWV

SEQ ID NO: 195 - DNA, 4182 bp, Cochliobolus heterostrophus strain C4 (ATCC 48331)
  CDS (1001)...(2182): Exon
  CDS (2238)...(2367): Exon
  CDS (2425)...(2549): Exon
cacaacagattgtgtttgacatggagaagagggggataccggcgtacggggcgatatttgattcttaggcttgcattgggcctacgcgctagacgagacgacgcgcacgacttgacgatttccgagtcatgatgttatgagttgcatgtatgtacatattgaatgaatgatgttgcatgtccaatgcagtctttgcacgttgcctctttgcgaaggtgtgagcacgacgagcggtagcccggcggggttctccgctgctactgagcacgtgagcagtcttggcagcttggcagtccgacacgtccgagcctgcgtcactgaagaagaagaaaagaaaggaatcgagggtcggacgcgccggtacccctgaggctgcccagctggagacaccttccgttcacatgggctgctccgcagttccttttcttggttcggcgtcatcttagacagcgaaatatcatgaataccattcgggcagcttctttgcattaacctataaaggctgctcgacgatggcgtcactcgattggaacgccaagtcgcagacaaccgccctatgcgttagcagctgcgcatcaccattcaagctttgccccgaaacatttgcttttgtgtcgccctccaatctatcttatcaaacaaagcagctcatacgggcaggccagccctggtcacgatgcacagcacgatctacttgatcctcccgggcaggtgcataagggaaggactacggaggattgaccaaagaagaaggagatgttgctagcgcccccagccaattcgcaaagccgcccaatcacggacttgccaacccatccccacgccgacgcaactaggcttaacgatgtattatcacagccgttagaagaaggtcgctcatcatgccatggggccgcacagaatgtataaggcctcttccgtgctgcaataaccagtccgccagagttacttcgtgctttcgctttcacatccctcattctttttccaaatccatctcaagatgaagtactctctcgccgcagccctgattctccagggtacaactgtacttggcagccttctccccgttcacttcaaggcacccagcccttcccacttcctcgacattgtcaacaatggcacatacgatctgggctgccgaccaaaggctgtaccacatgaggacggccactttgagcttcatgctctcctgaccgaggagcaaattgcccacctcgaaagggaatatgagcactctggggagatctctctccaccgacgcgacctcagcaagagggctgccgacgcaccaatcggcactggtgacaggtggcaaggtggtgccgtcacaccttcaggtcttggaaccaaagctgcgggatcaacagtcagctccatcatgaaccctaccgagatcaactcggcaatcaagggtctcgttaacggttatggtatcaacaccattactctgccatacaagactttccagggtgctacgcagaccgctggatacgtcggtgctggtacggacaagtcgcagtacaagctctacctcagtgctggcatgcacgcccgtgagcgaggtggtcccgatcagctcatttactggatctccgacttgcttgctgccaacaaggctggaaccggtctcacatacggcaggaagacctacaccaacgcccaggtcaagagcgttctcgctgccggtattgtcttcttcccccttgtcaaccctgacggagttgcctacgatcaatcctctggctccctctggcgcaagaaccgaaacactcgctccggcacaagcggcgcatccgtcggtgtcgatatcaaccgcaactttgatttcctctggaacttcaagaagttcttcgacccatccacctcgcctgcttccacctcgcccagttcggaggctttttacggcactgccgccgcatctgagcccgagaccaagaaccacatcagcatctacgacagcttccccaagatcaggtggttcatggatatccactctgctactggtgacatcctatacaactggggtgacgacgagacacagtccacaaacagcgctatgaacttccttaacactgcttatgacggaaagagaggtcgtatcggcgacagcacatacaaggagtacatgccctctgccgatgtcaccggcatcaagagcgttgcctccaagacggctgctgctagtaagttgacccttcagaagttttgtataatatctgaactgacattcgtatttagtggccgctgtaggtggacgttcatacacatccatgcaatccgttggtctctacgccacttccggtgcctcggatgactacgccgccagccgcgtgtacgccaaatccggtgctaacaaggtctttggctgtaagtcttgattcttctaccttgtggtgtatgtatactgactttgcacgcctgtagtcaccatggagtttggatacgcaaccaacttttaccccactctcaccgagttcaaccagaacatccttgacaccaatgctggtttcatggattgggcacttgctgccattgctgttggagttaactgaggtgcgatcttgacaaaagtgatattgaaatgatgtggcgatgtggcgtttctaaggactcggcggagagcctgggatgatgatgatttgacttctatgtaaatacctttatctgcattttctattttgaaaagatgaaatataatcaatattgctacaacaagagtttttcacatgttggaggtctagggaactggccctgttccatcgtgaagtttagacaattgagtcagtaatgcttcttttggacaaaaggctatatcctcgttatcgcacatgaaaactcatagttcctctccccgatacttcaaactcccatttttgatggatctcatgtctttccgtcatgtcccgtgcgtcctcaggtagatacggaccgactagctccacaaacatcgtactgacagcaatgaatctgctgtgctatgagaaagaggcactttcaacgttaagtaactatatgccagaggcaaggctattcctgggctccaagtctcttcaatcaatcttttcagctttactgaaagccttcaacttataccaatgttggataagcgaacagcttctcagccgcactttagctgtgcccttttaggcggcgaggctgaaaagtagccaatcgtacctcagccacgccggcattgcatgtacatagcccattactttgcgccacggtaaactgtaaatttgcagtagcagcccagctttcaggccgccgtcgtgacctttcgccgccgacatcgttactgtctcgcgttcataccaccacacctgtgacgcccaatcagcacaacagcgtcgacaaatggctgggaaactgccgctgccaagtactcaagaaacaagttcccgaatgtcgcctgcgctgaactttgcgacactggcaagggctatcggacgcgttacacaggttctacaagtaagcatgggaacatcccttggcagcgaacaacccgtctttcataacagagctagacaccaccaataaatcaagaaagatacaataatcactaacccacccccaaccagcgtctctggaacgttatagaaaccctcataatccgcatagcaacactcccatactaccgcctctaccacttcaacaccatcaatcccctccgcaacctcgcctacctcgcctcatcccccaaccccgacaccaaaaaacttcactccacactatcaagctggcgtaccagaaaacttaacgaactccaatttactacaatctctgtaagtctcccccctttttttttctcatcgcccctaccaccaccatccacccagtcccgacaacatacacacacacacgtctaaaccgaattcacccaagaacaaaaaaggcacatgttaaacttaacttactatattttctttctttgatctaataatgaacacagtgcaccgtcctcgccgccgccgtcatcggcgccttctcctggcccacactctccaccgcgcactggctcacccccggattctggcataccagcttaatcctatcgattttagggatcttgctatcggcgtctgagattacggttttgaatttattggggccggtcaggtacacggctgctgctgctgcctcctcgcatcttccatcaccctcttcctcctctacctcacc

SEQ ID NO: 196 - protein, 394 aa, Cochliobolus heterostrophus strain C4 (ATCC 48331)
MKYSLAAALILQGTTVLGSLLPVHFKAPSPSHFLDIVNNGTYDLGCRPKAVPHEDGHFELHALLTEEQIAHLEREYEHSGEISLHRRDLSKRAADAPIGTGDRWQGGAVTPSGLGTKAAGSTVSSIMNPTEINSAIKGLVNGYGINTITLPYKTFQGATQTAGYVGAGTDKSQYKLYLSAGMHARERGGPDQLIYWISDLLAANKAGTGLTYGRKTYTNAQVKSVLAAGIVFFPLVNPDGVAYDQSSGSLWRKNRNTRSGTSGASVGVDINRNFDFLWNFKKFFDPSTSPASTSPSSEAFYGTAAASEPETKNHISIYDSFPKIRWFMDIHSATGDILYNWGDDETQSTNSAMNFLNTAYDGKRGRIGDSTYKEYMPSADVTGIKSVASKTAAA

SEQ ID NO: 197 - protein, 43 aa, Cochliobolus heterostrophus strain C4 (ATCC 48331)
VAAVGGRSYTSMQSVGLYATSGASDDYAASRVYAKSGANKVFG

SEQ ID NO: 198 - protein, 42 aa, Cochliobolus heterostrophus strain C4 (ATCC 48331)
FTMEFGYATNFYPTLTEFNQNILDTNAGFMDWALAAIAVGVN

SEQ ID NO: 199 - DNA, 1437 bp, Cochliobolus heterostrophus strain C4 (ATCC 48331)
  CDS (1)...(1437)
atgaagtactctctcgccgcagccctgattctccagggtacaactgtacttggcagccttctccccgttcacttcaaggcacccagcccttcccacttcctcgacattgtcaacaatggcacatacgatctgggctgccgaccaaaggctgtaccacatgaggacggccactttgagcttcatgctctcctgaccgaggagcaaattgcccacctcgaaagggaatatgagcactctggggagatctctctccaccgacgcgacctcagcaagagggctgccgacgcaccaatcggcactggtgacaggtggcaaggtggtgccgtcacaccttcaggtcttggaaccaaagctgcgggatcaacagtcagctccatcatgaaccctaccgagatcaactcggcaatcaagggtctcgttaacggttatggtatcaacaccattactctgccatacaagactttccagggtgctacgcagaccgctggatacgtcggtgctggtacggacaagtcgcagtacaagctctacctcagtgctggcatgcacgcccgtgagcgaggtggtcccgatcagctcatttactggatctccgacttgcttgctgccaacaaggctggaaccggtctcacatacggcaggaagacctacaccaacgcccaggtcaagagcgttctcgctgccggtattgtcttcttcccccttgtcaaccctgacggagttgcctacgatcaatcctctggctccctctggcgcaagaaccgaaacactcgctccggcacaagcggcgcatccgtcggtgtcgatatcaaccgcaactttgatttcctctggaacttcaagaagttcttcgacccatccacctcgcctgcttccacctcgcccagttcggaggctttttacggcactgccgccgcatctgagcccgagaccaagaaccacatcagcatctacgacagcttccccaagatcaggtggttcatggatatccactctgctactggtgacatcctatacaactggggtgacgacgagacacagtccacaaacagcgctatgaacttccttaacactgcttatgacggaaagagaggtcgtatcggcgacagcacatacaaggagtacatgccctctgccgatgtcaccggcatcaagagcgttgcctccaagacggctgctgctgtggccgctgtaggtggacgttcatacacatccatgcaatccgttggtctctacgccacttccggtgcctcggatgactacgccgccagccgcgtgtacgccaaatccggtgctaacaaggtctttggcttcaccatggagtttggatacgcaaccaacttttaccccactctcaccgagttcaaccagaacatccttgacaccaatgctggtttcatggattgggcacttgctgccattgctgttggagttaac

SEQ ID NO: 200 - protein, 479 aa, Cochliobolus heterostrophus strain C4 (ATCC 48331)
  SIGNAL (1)...(18)
  DOMAIN (124)...(344): Zinc carboxypeptidase
MKYSLAAALILQGTTVLGSLLPVHFKAPSPSHFLDIVNNGTYDLGCRPKAVPHEDGHFELHALLTEEQIAHLEREYEHSGEISLHRRDLSKRAADAPIGTGDRWQGGAVTPSGLGTKAAGSTVSSIMNPTEINSAIKGLVNGYGINTITLPYKTFQGATQTAGYVGAGTDKSQYKLYLSAGMHARERGGPDQLIYWISDLLAANKAGTGLTYGRKTYTNAQVKSVLAAGIVFFPLVNPDGVAYDQSSGSLWRKNRNTRSGTSGASVGVDINRNFDFLWNFKKFFDPSTSPASTSPSSEAFYGTAAASEPETKNHISIYDSFPKIRWFMDIHSATGDILYNWGDDETQSTNSAMNFLNTAYDGKRGRIGDSTYKEYMPSADVTGIKSVASKTAAAVAAVGGRSYTSMQSVGLYATSGASDDYAASRVYAKSGANKVFGFTMEFGYATNFYPTLTEFNQNILDTNAGFMDWALAAIAVGVN

SEQ ID NO: 201 - DNA, 3380 bp, Cochliobolus heterostrophus strain C4 (ATCC 48331)
  CDS (1001)...(1592): Exon
  CDS (1641)...(2380): Exon
  misc_feature (1)...(3380): n = A,T,C or G
tagctggaatctctttacattttatgttgttaaatgcgatttgggcttcttgtttggtgatttcgtttgtcactttcgttgcttttgaaatcgagtgccattgcccaacagtagggttgatcatgaatgtgtagttcccgccttgtactttcttgctaccaggttcattgtgtagaagtaaatgtatgtaggaagccagtcgtgaagttttgaatactaggaacaatttactatggggcaatcgaaagcctgtttgttacaggaatgtaagagaggggctgggatacatgctcaaataggcgagttggccaagcatgcagaacaagcgtgcttacggtacttgtgttccaaaaccttatacatgactgtgagtcctgttcgccggtatgccttttgaataagcttccaattctgcttgctgtgttcatacgcgtgaaacttgcaaaacatcgtagaccgtagagacgtagctcaatgcgacgtcatcaaagcaccgatatcgtctcttgaggagcatcatgttgaaacatcatttgtctctcaagaaaaagaacacgcaggtttccaatgatctttggaatcaagcatgaggctacagaatagctatggaacaggaattttgtacggcttttcaacggctttcgacgggatcagcaatatacccgggggctgagggggagttgcatacccgacctgccttgctccttggcgatgcgtctagatcaggaagctgggggtacataagtatacacaagcctgggcatcgccttggctagcgggcgaacgacgctccacctactgaatatgattccagtgatgcaaatgaacacggcaatgctgtgcgagctagcatgacagttccatggcgacattcgattattgcaccgagcttcccgacgcgcagataaggttagaacaggggtccaaagtcatatttaagaagtgtatatgatgttgtaatgacttgtgtgttgtgtttgttaactctccgaacttcaaaatgagattgtcaaagttggtggtggccgctcaattggcagcagcgtctcctttggcacacgacgctagctctgtgtctcgcagtgccaacccaagctacgatggctaccaaatctactccattacgccatcttctgccgaagaagctcatgatatcaacaagcgcttctccaactaccacactcacccgattcgcaacaccctgtcagttgctattccacccgaggagattgactcttttcgtgcactgggtttgaacgctcgcctggtgaactcggatctgggcaagtacattcgctctaccgacaaggaagccgtatacaagcgtgacttgcatgcaacgggtcagctcccggacctgtcgtggttcgacacttaccatgcttattccgaccaccttcagtactgggacgaccttgttgcggcgttccctggtaactctgagaagttttcgattggccagagttatgagaaccggacaatttgggcgttccatttgtttggtgacaagagcactgaagctgcaacgcaagaaaagcccattattctttggcatgccacagttcacgcaagagaatggatctccactatgggtaagcagaacacgcatgagaaaaaggaatactagctaacgctcccagtcatcgagtacctagcctaccagcttattgacgggtaccaaaaaggcgatgcaaatgtgactagttttctggaccactacgacttctacctcgtccccttccacaacccagacggcttctcgtacacacaaaccaacgaccgactatggcgcaagaaccggcagccgcgcccccaactaaacacggcctgtgtcggcaccgacggcaaccgcaactggaagtttgaatgggacgccacgcctccagacggtggttcaacgcccaatccgtgcggagagacgtaccgtggcgaagccgccggcgacacacccgagaatcaagccatggacggactctctgctaagctttccagcacgggcgctggcatccggtccttcatcgacttccactcgtacagccagcttatcctcactccctggggtttctcgtgcgacccgctccccgaaacgcttccccgtatgctcgaggtagcaggcggcactgccagagctatccaggcgggcagcgcgcgaaacgtcacgtacgagtttgggcctggctgtcagattctgtacttctccacgggcaactcgagagaccaccaccatgctgtgcatggcgcggcgcactcgtggactatggagctgagcccccaggacgcggcaggaggcgggtttgttctgccgcctgaactcatttggccgacggtcaaggagcagtgggcgggccagttgtggttgttgaatgatgtttgggataactgagcttttggtgcaatggcacaggaatatcatgcactgttggatggcatatttgcctagattggctacgagatagatgctatgaaacattctgtgaactggctcttgaagcattgcagatgttcaagtgatgtgtttatgattggagtaagatctggagcttgacctataagcagtgccttatacccacatcttcctctatccatatcgtcctcatgtcctcatgtcctcatgtcctcattgtcccaactcacagttacaaaatatcaggagcacaagtacaggtttcaacattatatctatttaaatgcgagacagtggacagttagtaaatgaacaggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcataggcgtcatgtggcgtgaggagaaacactaaagttggacacaagggcattgctcatcagacagagactatgagcttcatccgaacatgcggttctcgtattgatagatggtcagactccattaggggtagtcagtgcatactggattggagcaagatcgaaactgagtcatcatcgcccaaaggacgatttcgaaaagcccaagacctaatcaacgagggtcgtatattgaatcgaaaatctctcagacgatgagtacttgtgagcatgaaatgcgaagaattgataatggcacgaggttctggtgtagtgaacgacaagaagctggtcgcattgttgacggcgggttggagatttggatctgcaagtgcagtctcgaaaatctttacggtcaggctctcgttggtggtgac

SEQ ID NO: 202 - protein, 197 aa, Cochliobolus heterostrophus strain C4 (ATCC 48331)
MRLSKLVVAAQLAAASPLAHDASSVSRSANPSYDGYQIYSITPSSAEEAHDINKRFSNYHTHPIRNTLSVAIPPEEIDSFRALGLNARLVNSDLGKYIRSTDKEAVYKRDLHATGQLPDLSWFDTYHAYSDHLQYWDDLVAAFPGNSEKFSIGQSYENRTIWAFHLFGDKSTEAATQEKPIILWHATVHAREWISTM

SEQ ID NO: 203 - protein, 247 aa, Cochliobolus heterostrophus strain C4 (ATCC 48331)
VIEYLAYQLIDGYQKGDANVTSFLDHYDFYLVPFHNPDGFSYTQTNDRLWRKNRQPRPQLNTACVGTDGNRNWKFEWDATPPDGGSTPNPCGETYRGEAAGDTPENQAMDGLSAKLSSTGAGIRSFIDFHSYSQLILTPWGFSCDPLPETLPRMLEVAGGTARAIQAGSARNVTYEFGPGCQILYFSTGNSRDHHHAVHGAAHSWTMELSPQDAAGGGFVLPPELIWPTVKEQWAGQLWLLNDVWDN

SEQ ID NO: 204 - DNA, 1332 bp, Cochliobolus heterostrophus strain C4 (ATCC 48331)
  CDS (1)...(1332)
atgagattgtcaaagttggtggtggccgctcaattggcagcagcgtctcctttggcacacgacgctagctctgtgtctcgcagtgccaacccaagctacgatggctaccaaatctactccattacgccatcttctgccgaagaagctcatgatatcaacaagcgcttctccaactaccacactcacccgattcgcaacaccctgtcagttgctattccacccgaggagattgactcttttcgtgcactgggtttgaacgctcgcctggtgaactcggatctgggcaagtacattcgctctaccgacaaggaagccgtatacaagcgtgacttgcatgcaacgggtcagctcccggacctgtcgtggttcgacacttaccatgcttattccgaccaccttcagtactgggacgaccttgttgcggcgttccctggtaactctgagaagttttcgattggccagagttatgagaaccggacaatttgggcgttccatttgtttggtgacaagagcactgaagctgcaacgcaagaaaagcccattattctttggcatgccacagttcacgcaagagaatggatctccactatggtcatcgagtacctagcctaccagcttattgacgggtaccaaaaaggcgatgcaaatgtgactagttttctggaccactacgacttctacctcgtccccttccacaacccagacggcttctcgtacacacaaaccaacgaccgactatggcgcaagaaccggcagccgcgcccccaactaaacacggcctgtgtcggcaccgacggcaaccgcaactggaagtttgaatgggacgccacgcctccagacggtggttcaacgcccaatccgtgcggagagacgtaccgtggcgaagccgccggcgacacacccgagaatcaagccatggacggactctctgctaagctttccagcacgggcgctggcatccggtccttcatcgacttccactcgtacagccagcttatcctcactccctggggtttctcgtgcgacccgctccccgaaacgcttccccgtatgctcgaggtagcaggcggcactgccagagctatccaggcgggcagcgcgcgaaacgtcacgtacgagtttgggcctggctgtcagattctgtacttctccacgggcaactcgagagaccaccaccatgctgtgcatggcgcggcgcactcgtggactatggagctgagcccccaggacgcggcaggaggcgggtttgttctgccgcctgaactcatttggccgacggtcaaggagcagtgggcgggccagttgtggttgttgaatgatgtttgggataac

SEQ ID NO: 205 - protein, 444 aa, Cochliobolus heterostrophus strain C4 (ATCC 48331)
  DOMAIN (124)...(340): Zinc carboxypeptidase
MRLSKLVVAAQLAAASPLAHDASSVSRSANPSYDGYQIYSITPSSAEEAHDINKRFSNYHTHPIRNTLSVAIPPEEIDSFRALGLNARLVNSDLGKYIRSTDKEAVYKRDLHATGQLPDLSWFDTYHAYSDHLQYWDDLVAAFPGNSEKFSIGQSYENRTIWAFHLFGDKSTEAATQEKPIILWHATVHAREWISTMVIEYLAYQLIDGYQKGDANVTSFLDHYDFYLVPFHNPDGFSYTQTNDRLWRKNRQPRPQLNTACVGTDGNRNWKFEWDATPPDGGSTPNPCGETYRGEAAGDTPENQAMDGLSAKLSSTGAGIRSFIDFHSYSQLILTPWGFSCDPLPETLPRMLEVAGGTARAIQAGSARNVTYEFGPGCQILYFSTGNSRDHHHAVHGAAHSWTMELSPQDAAGGGFVLPPELIWPTVKEQWAGQLWLLNDVWDN

SEQ ID NO: 206 - DNA, 3999 bp, Cochliobolus heterostrophus strain C4 (ATCC 48331)
  CDS (1265)...(1549): Exon
  CDS (1609)...(1950): Exon
  CDS (2001)...(2999): Exon
  misc_feature (1)...(3999): n = A,T,C or G
cgtgccgagcgtttacttcttttttcctgagccaaagggacgcagtttggaggagctggatgtcatttttgcgagtgcgaatcagatgggggttagtcctgtgaagagagcgagggagatggagaagctggtggggagggagttggatgaggagattgcgagattttttgggggtgatgtggaggaggttaggcggaggagcagagcttgagaggtggattggaattttcgatgtgtaggcacgcgtgcaggttgattgtcgtgattttgacgtggccttgggcggtactttttttcatgcactctgccggtgtaggtggtgcccggccatcttgacacgagtttccggtcaacagcaaggttgtaccgagacggcttaagttgggaacatcaaatccatgcagcacgagttgtactgcaaatccaataacaccctatcgcgatgatcgatagatggcgacctgccgactgcagctagcgttacacaccggcaatatcgatgtcgcggggggctgggtgcctcattctcctcttttgcaacggtccaaaacgccacaacgctttcaactacgccccaacctccagattggggctacaactatgacgttgataagctttcctcggctcaacgaacgacttggcaagaggccttattccaccattgcgcatagcgagcttcttgtttgggtaaggtgtgtgatttgatgtgcgtagactactcggacctcattggagaaaacacacacaaatcgtcactctctttcatcgatggaaaaacacgccttagacagcagtttcgatggctgaaaaattgcggcataggttgcatctttgactcgatgccttttgtcctaagccataattagtaaccggtgatacaaaatccaaccgcggcaaacaagttgtacttctgaaagctcttactagtattgtcgccttaacgcggaactcgcaagatcttcatactcgtgttatcccggccaattgcaatgaccagtactactttgcagttgcctgattcggattaaacctacctgcactggcctacccacagatcgcatttggcctcacatggagccagcccgccatgcagtgctcagccatggcaggcggaaagaaatgtacatagccgcatcattgcatgttgttaaacggcttagcctcgtacgcattcagtgtatttaagaaggccgagagaagcggccttctcggcaagcccgctgcttaagccttggtcattcttcttcacgacaagctattcaccatggcgcgcttcacccagattgttgctgtcttggcagcagcgacgctcagtcatgctcgcaagccattcatcactgagcgtcaggtcccggctgaccccactggcgtcacaaccatcaagtctgctcagggtgccgagattcgctacaagcagcctggaaaggcgggagtttgcgagactactgaaggtgttgacgattatgccggttacatcagtctcaatcctactaccaacatgttcttttggttcttcgaggcgcgtgaaaacccctccgaaaagccgttggcaagtacaacctatatttcagctcagaattcggtagcagattctaactttgtttccagacactttggttgaatggtggaccaggaagtgactcgctcatcggtctcttccaagaacacggcccatgtaatgtcactgaggatttgaagacacaattgaatccttattcatggaacgagcacagcaacatgctctacctctcgcagcctgttggtgtaggcttctcctacgagaccacagaaaccgacgcggacggtcgatactcgcttgttgatcccgataccacaaacactaccgatgctgcagccatcggtgcgtggcacattctccaggctttcttggacctgagcccccagctcgacccggatatcactaactttacattcaatctttggactgagaggttagtgattcagcaacaagactgaaaacgtattgctcaccagtttctagctacggaggacattacggccccggtttctacaactacttctaccaacaaaatgagaagatcaagaacggctcttcccctggtgtcgagattcgcatggacactctcggtataatcaacggaattgtcgatgagcagatccaggccccttactaccccgagtttgctgtcaacaacacctatggcatcaaagcagttaacgacacggtttacactttcatgaagaacgcctactacatgccagaaggctgccacgatcaaatcgaatactgcaagcaatccgaccgcaccacccaagacggctatctaacttgttcatccgcaaccaacctctgccgatcgctcgtcgaagagccatattacgcatttggcgggcgtggcgtctacgacatccgccatccctacgacgaccctacgccccccgactatttcgagtccttcctgaacctggcctcaacccaagaagccatcggcgtaaacatcaactacacgagcaccaacgcccgcaacgtgtccctcggcttcagtcgcaccggcgacttcgtcttccccaacttcctcgaggacctcgaagaaatcctcgcctacggcgtccgcgtcgccctcctctacggcgacgcagactacatctgcaactggttcggcggcgaagccgtctctctggccgtcaacttcacgcacgccgccgacttccgctccgcgggctacacgccctttctcgttgacggcgtcgagtacggcgaggtgcgcgagtacggcaatttctccttcacccgcatctacgaggccggccacgaggtcccgtattaccagcctgaagctagtctggagcattttaggcgcgtcctgcatcatgtcgttgttgcggatgggagccaggtggtcacgagtgattacaagacgaatggcaccgccaaggcgacgcatacagaggagtttgtcccgttgccgccgacgagtacgccgagtgctgctagtagggtgaggaggggatcggtgtagattggccgtgggggcggtgagacgggtgatgaagtttagagccttgtgtgaggcattgatgtatgacgttaatgacttgaaatgaaagtaattgaatcatgagttcagaggaaatactgcttgtctactgttataagacgtctgaaatgagtaggtttgacccttttaccatttgcacaatcttttctttcgtgtgcacattgctttttgtaaacttgttttggctttcttttaagagtatcacgccttgttgccgactgtaccgacgcgtttacttggcaaatgaaagtcgtttcgaggaaagctaggtccgattgattactgtttacttccctttccgatcgttctggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccaccaaactcacacacctctcccatcttatcatacaatggctcaacgcagcgctactctattagcttcaaatgaattagatattcagcttgcgatctctttaattaattctaagcagattctaagtaatcggagtgctgctgctatctacaacgtgtttaaatgaacgatccgccgccaacgcgctggtgtccctgcgcgacgtgattgccagcctaacttaaagaagctaacctagctagaagaggaggtaattgttagctatatactcaatctagattagcgtggattcgcgcctacgtacgcagccgtgcgcgatatagctaataagctgctagctacgcgtagtagaggacgcgttagagttaactagccgtctacctttattaagcgt

SEQ ID NO: 207 - protein, 95 aa, Cochliobolus heterostrophus strain C4 (ATCC 48331)
MARFTQIVAVLAAATLSHARKPFITERQVPADPTGVTTIKSAQGAEIRYKQPGKAGVCETTEGVDDYAGYISLNPTTNMFFWFFEARENPSEKPL

SEQ ID NO: 208 - protein, 114 aa, Cochliobolus heterostrophus strain C4 (ATCC 48331)
TLWLNGGPGSDSLIGLFQEHGPCNVTEDLKTQLNPYSWNEHSNMLYLSQPVGVGFSYETTETDADGRYSLVDPDTTNTTDAAAIGAWHILQAFLDLSPQLDPDITNFTFNLWTE

SEQ ID NO: 209 - protein, 333 aa, Cochliobolus heterostrophus strain C4 (ATCC 48331)
SYGGHYGPGFYNYFYQQNEKIKNGSSPGVEIRMDTLGIINGIVDEQIQAPYYPEFAVNNTYGIKAVNDTVYTFMKNAYYMPEGCHDQIEYCKQSDRTTQDGYLTCSSATNLCRSLVEEPYYAFGGRGVYDIRHPYDDPTPPDYFESFLNLASTQEAIGVNINYTSTNARNVSLGFSRTGDFVFPNFLEDLEEILAYGVRVALLYGDADYICNWFGGEAVSLAVNFTHAADFRSAGYTPFLVDGVEYGEVREYGNFSFTRIYEAGHEVPYYQPEASLEHFRRVLHHVVVADGSQVVTSDYKTNGTAKATHTEEFVPLPPTSTPSAASRVRRGSV

SEQ ID NO: 210 - DNA, 1626 bp, Cochliobolus heterostrophus strain C4 (ATCC 48331)
  CDS (1)...(1626)
atggcgcgcttcacccagattgttgctgtcttggcagcagcgacgctcagtcatgctcgcaagccattcatcactgagcgtcaggtcccggctgaccccactggcgtcacaaccatcaagtctgctcagggtgccgagattcgctacaagcagcctggaaaggcgggagtttgcgagactactgaaggtgttgacgattatgccggttacatcagtctcaatcctactaccaacatgttcttttggttcttcgaggcgcgtgaaaacccctccgaaaagccgttgacactttggttgaatggtggaccaggaagtgactcgctcatcggtctcttccaagaacacggcccatgtaatgtcactgaggatttgaagacacaattgaatccttattcatggaacgagcacagcaacatgctctacctctcgcagcctgttggtgtaggcttctcctacgagaccacagaaaccgacgcggacggtcgatactcgcttgttgatcccgataccacaaacactaccgatgctgcagccatcggtgcgtggcacattctccaggctttcttggacctgagcccccagctcgacccggatatcactaactttacattcaatctttggactgagagctacggaggacattacggccccggtttctacaactacttctaccaacaaaatgagaagatcaagaacggctcttcccctggtgtcgagattcgcatggacactctcggtataatcaacggaattgtcgatgagcagatccaggccccttactaccccgagtttgctgtcaacaacacctatggcatcaaagcagttaacgacacggtttacactttcatgaagaacgcctactacatgccagaaggctgccacgatcaaatcgaatactgcaagcaatccgaccgcaccacccaagacggctatctaacttgttcatccgcaaccaacctctgccgatcgctcgtcgaagagccatattacgcatttggcgggcgtggcgtctacgacatccgccatccctacgacgaccctacgccccccgactatttcgagtccttcctgaacctggcctcaacccaagaagccatcggcgtaaacatcaactacacgagcaccaacgcccgcaacgtgtccctcggcttcagtcgcaccggcgacttcgtcttccccaacttcctcgaggacctcgaagaaatcctcgcctacggcgtccgcgtcgccctcctctacggcgacgcagactacatctgcaactggttcggcggcgaagccgtctctctggccgtcaacttcacgcacgccgccgacttccgctccgcgggctacacgccctttctcgttgacggcgtcgagtacggcgaggtgcgcgagtacggcaatttctccttcacccgcatctacgaggccggccacgaggtcccgtattaccagcctgaagctagtctggagcattttaggcgcgtcctgcatcatgtcgttgttgcggatgggagccaggtggtcacgagtgattacaagacgaatggcaccgccaaggcgacgcatacagaggagtttgtcccgttgccgccgacgagtacgccgagtgctgctagtagggtgaggaggggatcggtg

SEQ ID NO: 211 - protein, 542 aa, Cochliobolus heterostrophus strain C4 (ATCC 48331)
  SIGNAL (1)...(19)
  DOMAIN (52)...(494): Serine carboxypeptidase
MARFTQIVAVLAAATLSHARKPFITERQVPADPTGVTTIKSAQGAEIRYKQPGKAGVCETTEGVDDYAGYISLNPTTNMFFWFFEARENPSEKPLTLWLNGGPGSDSLIGLFQEHGPCNVTEDLKTQLNPYSWNEHSNMLYLSQPVGVGFSYETTETDADGRYSLVDPDTTNTTDAAAIGAWHILQAFLDLSPQLDPDITNFTFNLWTESYGGHYGPGFYNYFYQQNEKIKNGSSPGVEIRMDTLGIINGIVDEQIQAPYYPEFAVNNTYGIKAVNDTVYTFMKNAYYMPEGCHDQIEYCKQSDRTTQDGYLTCSSATNLCRSLVEEPYYAFGGRGVYDIRHPYDDPTPPDYFESFLNLASTQEAIGVNINYTSTNARNVSLGFSRTGDFVFPNFLEDLEEILAYGVRVALLYGDADYICNWFGGEAVSLAVNFTHAADFRSAGYTPFLVDGVEYGEVREYGNFSFTRIYEAGHEVPYYQPEASLEHFRRVLHHVVVADGSQVVTSDYKTNGTAKATHTEEFVPLPPTSTPSAASRVRRGSV

SEQ ID NO: 212 - DNA, 4330 bp, Cochliobolus heterostrophus strain C4 (ATCC 48331)
  CDS (861)...(1172): Exon
  CDS (1222)...(1461): Exon
  CDS (1520)...(1714): Exon
  CDS (1768)...(1931): Exon
  CDS (2000)...(2330): Exon
catgtgggctgactgcctaatcgttattccgcgtcggagtggcagcacagagggtgcaagtgcgaatacggggggtatgctagggagtgtctgggtgacgagccaggaacaagtcgacgaatggcttagaattggttgtgcaaacgtgctcagggaactgggtgtgccttcttaggaggagtaaacgtcagacatgtcggtcgtcggcacctgtcgctttcaaccaggctagttataatgtgcatgcctgtctaccacttggcggccgccttccaatgatctccttcccgtttcagctcatcgcttcgaaccagctatgcccttgctacactgcatcgggtcgactagttgcccatcacgacaagatcacgtcttccagctacgcacaccttgatttgccctatcgcatagccaagaccagccatcatgctctccgagaattccgggccctacacctgcctaacccggtaagcacatacgactccggaccaatcatcttgttcgcgcccacgtctctcctccagcgcgccaagtgattccataaattaatcctccatccatggcccaggcgtttactccgacctccttcgaatgaccatctcccgcgcttgtaaggcctatcttggtcttcttattcgagtgcacatctcccgttcgtgcagacgactaccacgaaactggggtacctgcctattccatacaatttcgattaagagacagggacatgtcggccatgctacttgacaggaaggtagatcgtaactaggtatgactatggagaagcataaaaagcagcgctccccacggcctgtattacgttgcaccttgcttctacagagtcagtgtctccatctctcatcatgaagactactatctttacctccgcccttctccttggctccactgccttgggcagcgctgtcccaaccgctggcaagaaggtcgattacaatggcttcaaggtcctgcgcgtttctagcaccgacgctgtcaagagtcaaatcgagaacttggctgcccacatcctcaaccctggcaagtctgccgagatggatgtagttgttgcacccgaaaacgttgcggcattgactgcgttggcttccgagagcaaggtcatcaatgaggatgttggtgctgccctcaaggaagaaggcgagatgggaatctacgctggtttgtaattggctcaatatcttcgaggttacacactcaccgaatatagttcccagcgagtcgtggttcacagcataccacccatatgccgatcatcttcaattcctccgcgatctgcaagccggctacactagcaattccgagattgtcacccttggtaactcagtccaaggacgtaccttgactggtatccatatctggggcagcggcggcaagggatccaagcctgccgttattatccacggaaacgttcacgcccgagagtggatcacttccatgaccactgagtaagccaccctgctatgagattattattgaaaaaaaacaagctaatctccacctcaggtacttcgcgtggcaacttctaaccaagtacgcctccgactcaagcgtcaaggctctcgtcgacaagttcgacttttacatcacccccatcgtcaaccccgacggattcgtctactcgcagaccacggaccgtctctggcgcaagaaccgtcagactgtcagcaccagctcgtgtgttggccgcgatatcaaccgtaagggaccatagaaattattgtatgattaacatgctaacattttatcaaaggcaactggccatacaagtgggaggtaactggcggagcctccaccaacccttgctcggagacctacaagggtcaggccgctggagacgcccccgagctcagggccatcaaagcccaagtcgatgctctgaagggaacgcgcggaatcagcctctacctcgacgtgcagtatgtcccccttgcatccccttctcccctttgccaaatcaagccaaagctaaccaccctacccttagctcctacggccaatacatcctctggccctacggctacgactgcagtctccgccccgaaaacgacgcccagctccgcagtctcgcatcccgcgctcaatcagccatccgtgctgtctcaggaactgcatacaccattggccccagctgctctactctctacgccaccactggctcttccactgattacaccgatgtcgagggtaatgctacctactcgtacacttatgagctgagggataccggtacatacggcttctcgctccctgccaaccagattcgtcccactgttttggagacttgggctggtgttactagcatgctccgcgatgcttagaatgatttatgatggatgagaaagggggaaacttttgtaaatactttttgacttggtcaacttgaacataaatcatgatgaaagtcatggattattaattttttgttgtacatacatgcatacataccttttctgggatggtccattgagtcacgttctatacactgtttgtttatttacctcactcgttttcgtcgctacccccttctccttgctctggctgttacacggcagcgttgttcgcggcgccgcgcggtgtgctacgtggggggcgaaaagaggcgttgtttcattcgcatgcacggcattattctttttccttgctttctgtccaacaaacgacaatgggaggagcagacacgataatagtgggaagggggggggggcaagcagttacaaaaggtatacgtgacaacttgcttccatgctcttctagcgtggttttgctgcttttcttatttcagtcttacgtctacatagtcagctctacattttttgtctttattttttttctcgctctgtattctctttcacaaattctcggagtttgtatctctcccaattttttgggtttccttggttgcagtgacagttgcgatggagatggagtggcgtaaagtgataccgcaggtagcactgcggcaagctgttcatgcagtgagaggattttaggatttatttgtgtattgagtgggatatcaggagatagggaactctatcccttctcctcttctttacctgatcaagtgtcactccacgtctatccaacattctccatcattgtaaaagccaaaacaaataaatttgctggatgaatcagtcgtactatctaaaaccatgttccttgtcagaagcgacccaaatcaacccacacaacaatacaacagccatgttgaaacggaattcaaggtagacaaccccatcatcctttgccatggagaaccccttcaccaaaaaaaaattccgcagtacaaagtccttcatctaacacttcacctagacctcccaaaaactaacctcaaccccctccaccccccctccgtcctcacactccaaaccccccctcagctccggcgcaaaaaccggtataataaccgcctgcatcatagtcttcatcctgctctgccttctcctcctcgagctcacatatttcggccgccaacgccgtctcgcgcgtgcgcggcgccaaggaaacgctggcggagacgtagagttgggtagagaggggagcagcaagaagaatgcggtattggagagtcgggtggagattgttgttgagggagaggcgagagaggcgagggagccgagggaggagagacagcaggatgcagaggaagaggaagacgatagtgatggggatgagtggggtggtggaaggaatgcgaggagtgggatgagtttgtcgaggagagaggggtagagaggcaaggacttttcgggaaggaacgagtgagagatagggtcggcgagggtaggtggaaggtggaaggtggtatggatgtgatggaagaggatgtaatacatctttaattagcgagatgaattgtaataagaagcaggcgtgtgcgaatattgcatctatgcccatgaaaagtgctcagtatgtaaatacacgcccccgctccttgcacctgtcatgatctttaggttctcggctgcaacggcatttctcacatcgttctgcatcgtcttcggcccgcagatatacacgttcagcgtctcatctgcttccgctgctttctctgcctcttcctgcacgatgagcggtagttgtggtcggcccgtatgttctttgcctgatacaattgtttcgccttctttctcggtactaaagacgatgtcattcgacgcttcagatggcactgagtgggttgatggctgtactatttttgacaggatgtcagcttgatttgccacttcaccagtgaagtggacctcgatttggacggatgacaagacttcagttggatattgtgaaaacatgacttgcagtgttt

SEQ ID NO: 213 - protein, 104 aa, Cochliobolus heterostrophus strain C4 (ATCC 48331)
MKTTIFTSALLLGSTALGSAVPTAGKKVDYNGFKVLRVSSTDAVKSQIENLAAHILNPGKSAEMDVVVAPENVAALTALASESKVINEDVGAALKEEGEMGIYA

SEQ ID NO: 214 - protein, 80 aa, Cochliobolus heterostrophus strain C4 (ATCC 48331)
VPSESWFTAYHPYADHLQFLRDLQAGYTSNSEIVTLGNSVQGRTLTGIHIWGSGGKGSKPAVIIHGNVHAREWITSMTTE

SEQ ID NO: 215 - protein, 65 aa, Cochliobolus heterostrophus strain C4 (ATCC 48331)
YFAWQLLTKYASDSSVKALVDKFDFYITPIVNPDGFVYSQTTDRLWRKNRQTVSTSSCVGRDINR

SEQ ID NO: 216 - protein, 55 aa, Cochliobolus heterostrophus strain C4 (ATCC 48331)
NWPYKWEVTGGASTNPCSETYKGQAAGDAPELRAIKAQVDALKGTRGISLYLDVH

SEQ ID NO: 217 - protein, 110 aa, Cochliobolus heterostrophus strain C4 (ATCC 48331)
SYGQYILWPYGYDCSLRPENDAQLRSLASRAQSAIRAVSGTAYTIGPSCSTLYATTGSSTDYTDVEGNATYSYTYELRDTGTYGFSLPANQIRPTVLETWAGVTSMLRDA

SEQ ID NO: 218 - DNA, 1242 bp, Cochliobolus heterostrophus strain C4 (ATCC 48331)
  CDS (1)...(1242)
atgaagactactatctttacctccgcccttctccttggctccactgccttgggcagcgctgtcccaaccgctggcaagaaggtcgattacaatggcttcaaggtcctgcgcgtttctagcaccgacgctgtcaagagtcaaatcgagaacttggctgcccacatcctcaaccctggcaagtctgccgagatggatgtagttgttgcacccgaaaacgttgcggcattgactgcgttggcttccgagagcaaggtcatcaatgaggatgttggtgctgccctcaaggaagaaggcgagatgggaatctacgctgttcccagcgagtcgtggttcacagcataccacccatatgccgatcatcttcaattcctccgcgatctgcaagccggctacactagcaattccgagattgtcacccttggtaactcagtccaaggacgtaccttgactggtatccatatctggggcagcggcggcaagggatccaagcctgccgttattatccacggaaacgttcacgcccgagagtggatcacttccatgaccactgagtacttcgcgtggcaacttctaaccaagtacgcctccgactcaagcgtcaaggctctcgtcgacaagttcgacttttacatcacccccatcgtcaaccccgacggattcgtctactcgcagaccacggaccgtctctggcgcaagaaccgtcagactgtcagcaccagctcgtgtgttggccgcgatatcaaccgtaactggccatacaagtgggaggtaactggcggagcctccaccaacccttgctcggagacctacaagggtcaggccgctggagacgcccccgagctcagggccatcaaagcccaagtcgatgctctgaagggaacgcgcggaatcagcctctacctcgacgtgcactcctacggccaatacatcctctggccctacggctacgactgcagtctccgccccgaaaacgacgcccagctccgcagtctcgcatcccgcgctcaatcagccatccgtgctgtctcaggaactgcatacaccattggccccagctgctctactctctacgccaccactggctcttccactgattacaccgatgtcgagggtaatgctacctactcgtacacttatgagctgagggataccggtacatacggcttctcgctccctgccaaccagattcgtcccactgttttggagacttgggctggtgttactagcatgctccgcgatgct

SEQ ID NO: 219 - protein, 414 aa, Cochliobolus heterostrophus strain C4 (ATCC 48331)
  DOMAIN (112)...(317): Zinc carboxypeptidase
MKTTIFTSALLLGSTALGSAVPTAGKKVDYNGFKVLRVSSTDAVKSQIENLAAHILNPGKSAEMDVVVAPENVAALTALASESKVINEDVGAALKEEGEMGIYAVPSESWFTAYHPYADHLQFLRDLQAGYTSNSEIVTLGNSVQGRTLTGIHIWGSGGKGSKPAVIIHGNVHAREWITSMTTEYFAWQLLTKYASDSSVKALVDKFDFYITPIVNPDGFVYSQTTDRLWRKNRQTVSTSSCVGRDINRNWPYKWEVTGGASTNPCSETYKGQAAGDAPELRAIKAQVDALKGTRGISLYLDVHSYGQYILWPYGYDCSLRPENDAQLRSLASRAQSAIRAVSGTAYTIGPSCSTLYATTGSSTDYTDVEGNATYSYTYELRDTGTYGFSLPANQIRPTVLETWAGVTSMLRDA

SEQ ID NO: 220 - DNA, 3554 bp, Cochliobolus heterostrophus strain C4 (ATCC 48331)
  CDS (1001)...(2554): Exon
  misc_feature (1)...(3554): n = A,T,C or G
cggcggcggcagcgttgactttgttggaacttggtcgagctacgcgctcttcaagagcggacacatcctagtcaacactatggagcgtggcgcattcgttgtcaagttgcaggcgggtttcgacaaataagcaaagaaggaataatgataatgatggcctaggctttcttgtatctagtcgagacgttgtagttctgtaaatatctatcggtcctagtcgtattcggccggtgcgagtgtggcttgacttatcaattcgtaatttggccaaacatactcggctttattccttgcccgctctttttttgatcatatacccgttgccaagtccagcgcataatagccgtagcagtagcgtagtgaaggctaccgaggctcggtttggtctggcacaacaagccactttagtcacacattgcgtattcttttgatcaaaatgggaacaacctgctgctaagccgagagcttctcgaagtgttccagtggcgggatcgtcgttttgcctcctccattatcatccgccctgattctggcgctatcatgccaaggcgattcgatgggggatggatgtctcttggcggggagtagattcttggccgccatctagcttcccaatcaagtgtcgtctggccgtgagctaggtatgtccgagagatgatgcggctattctccttcctcatacaacacagcatcacgcagccaagtcgactttcatcaatttcgtcgccttcgcccccagcccttcacccggctacccgtcaccaataacccacagcatgccttgaatacccatttcccggttcccgaaaagtggtcaactagcgatcgcgatagcagctgcctgaactggctaggccagggagcacgcgactatgctaacccaactctcgtagtcgtttatgaggatgtcagccagagtatatagagccatgcaattccggctgcatctggcacggcagccctctcagtctttgctcatccctcgttctcaatattcaagatgaggttcgttccattcgttgcgctcgctgcgcctgtccttgcccaggtcggtcccaagccaaacccaaacacaaagcccggcaagcctccaaagcctgacgacaagcctaagaagctcgtcactcccaaggatctgatcaaggacatcaaacttgaggatctgctcaagggctcccaaaagctccaagacattgccgacgaagctggcggtaaccgtgcttttggtggcacagggcacaacgcgaccaccgaatggttgtaccagactttgttggccactggttactatgacgtgtacaagcagccattcgttgagcttttcaccgctgctacgaccaagttcactgctggtggtgaagagattcccgtctcttacatgacctttggcccctctggcgatgccactgccaacattgtcaaggttaacaacctgggatgcgccgccgaagactaccccgctagtgtttctggccaacacgcactcgtctcccgaggcacatgtacttttgcccaaaagtctaccctggccaaggctgctggtgctgtaggcgcgctcatctacaacaatgagccagagcagcccctctcaggtactcttggaggtgcaggtgactacgctcctactgtcggtatgaccaaggaggctggagagtctctcattgctaagcttggaaacggcactacacttgagggaaccctcttcatcgatgccatccaggaaaaccgcaccaactacaacgtcattgctgagacaaaggagggcgaccacaacaacgttctcatgattggtggccacaccgactccgtcttccagggtcctggtatcaacgatgacggatctggtactattggtactctggttactggtcttgctctcaccaagtacaagatcaagaacgccgttcgtcttggtttctggggcgccgaggagtttggcaagcttggatccttctactacatgaagaccatcaacggtactttcggcggcagcaccgcagaggctaacaagatccgtgcctacctcaacttcgacatgattgcctcgcccaactatgtcctcggtatctacgatggtgatggcagtgcattcaacttttctggcgcagccggttccgacaagatcgagaaggactttgaagagttttacgaggagcgtggccttcctcacgtcccctccctctttaccctccgctccgactacgctgccttcctcgagaacggtatcccctctggcggtctcttcaccggtgccgaagtcctcaagaccgaggaggaggcccagctcttcggcggtgaagccggcaagcccctcgacggatgctaccaccaggcctgcgacgacatcaacaaccttgcccacgacgcctacctcctcaacacccagagcattgccaactccgttgccaagtacgccgtctctttcgagggtatccccaaggccaacgctactctccgcaaacgcggtgctgagtcggcaaggttcatgagcaggttcgaccacggtggccatgagcaccttggtcagccttgcggtgctggaaagcacgctatttaaatttcaatgtctataatgatttgctggggtgaaaggaaatgatgagatgataccatgagagaaatcttttgtaaaagtagatgaagaataatacccatttttttgtgttcattttgactagtcttatgctgtgcctggcgattgaatgctgtgaaatttcttttggttcctttttgtcagtttttcgtagttgtactattgctgtttgaaagagtcaagccatctagatatgtggcaccctaaccaactagacaaaggcatttaagtctgcttcctcactactaaatatccattaccctggaacattcatgtcagaaaagcacaagttttaaaacaaatagtttcttccagttcaactatcaaatacatattaaaccgcacaccctcccccctatattaccactcaagtccaacaacgaaaagattatatactgaaaaatctcctacccactcttatccactcctgcaaacaaaaaaaccccaggccgagattgaactttcctcctttctcctcacaaaccacgtgattggtgatatacagtagctaaatgccaccgaaaccctgtaccacgctccctactcaaatccacgttagttttatatactttttgtaattcgagatttctacacaatccattcccaacgaagatccgnnnnnnnnnnnnnnnnnnnnccccccaaaaaagaatgatagtgagagatgtagagaaacgggggaagtttagcaagggaaagaaaagagacatacgctcagatgttatcggtggccgagaagtccgtaagagcaactgtgatttcaccgactaccgggttggaatctcctcggcgctgtgagaaagttagctatgtatgtgcgtgtgtgttgggaggggggaaagggcgtacttctgatgggacagctccggagagagcttcggaggcagagtcagataccattgtgaggtccagctctggagcctcaatgggtctggcctgggcgactgaggcgaggacgagg

SEQ ID NO: 221 - protein, 518 aa, Cochliobolus heterostrophus strain C4 (ATCC 48331)
MRFVPFVALAAPVLAQVGPKPNPNTKPGKPPKPDDKPKKLVTPKDLIKDIKLEDLLKGSQKLQDIADEAGGNRAFGGTGHNATTEWLYQTLLATGYYDVYKQPFVELFTAATTKFTAGGEEIPVSYMTFGPSGDATANIVKVNNLGCAAEDYPASVSGQHALVSRGTCTFAQKSTLAKAAGAVGALIYNNEPEQPLSGTLGGAGDYAPTVGMTKEAGESLIAKLGNGTTLEGTLFIDAIQENRTNYNVIAETKEGDHNNVLMIGGHTDSVFQGPGINDDGSGTIGTLVTGLALTKYKIKNAVRLGFWGAEEFGKLGSFYYMKTINGTFGGSTAEANKIRAYLNFDMIASPNYVLGIYDGDGSAFNFSGAAGSDKIEKDFEEFYEERGLPHVPSLFTLRSDYAAFLENGIPSGGLFTGAEVLKTEEEAQLFGGEAGKPLDGCYHQACDDINNLAHDAYLLNTQSIANSVAKYAVSFEGIPKANATLRKRGAESARFMSRFDHGGHEHLGQPCGAGKHAI

SEQ ID NO: 222 - DNA, 1554 bp, Cochliobolus heterostrophus strain C4 (ATCC 48331)
  CDS (1)...(1554)
atgaggttcgttccattcgttgcgctcgctgcgcctgtccttgcccaggtcggtcccaagccaaacccaaacacaaagcccggcaagcctccaaagcctgacgacaagcctaagaagctcgtcactcccaaggatctgatcaaggacatcaaacttgaggatctgctcaagggctcccaaaagctccaagacattgccgacgaagctggcggtaaccgtgcttttggtggcacagggcacaacgcgaccaccgaatggttgtaccagactttgttggccactggttactatgacgtgtacaagcagccattcgttgagcttttcaccgctgctacgaccaagttcactgctggtggtgaagagattcccgtctcttacatgacctttggcccctctggcgatgccactgccaacattgtcaaggttaacaacctgggatgcgccgccgaagactaccccgctagtgtttctggccaacacgcactcgtctcccgaggcacatgtacttttgcccaaaagtctaccctggccaaggctgctggtgctgtaggcgcgctcatctacaacaatgagccagagcagcccctctcaggtactcttggaggtgcaggtgactacgctcctactgtcggtatgaccaaggaggctggagagtctctcattgctaagcttggaaacggcactacacttgagggaaccctcttcatcgatgccatccaggaaaaccgcaccaactacaacgtcattgctgagacaaaggagggcgaccacaacaacgttctcatgattggtggccacaccgactccgtcttccagggtcctggtatcaacgatgacggatctggtactattggtactctggttactggtcttgctctcaccaagtacaagatcaagaacgccgttcgtcttggtttctggggcgccgaggagtttggcaagcttggatccttctactacatgaagaccatcaacggtactttcggcggcagcaccgcagaggctaacaagatccgtgcctacctcaacttcgacatgattgcctcgcccaactatgtcctcggtatctacgatggtgatggcagtgcattcaacttttctggcgcagccggttccgacaagatcgagaaggactttgaagagttttacgaggagcgtggccttcctcacgtcccctccctctttaccctccgctccgactacgctgccttcctcgagaacggtatcccctctggcggtctcttcaccggtgccgaagtcctcaagaccgaggaggaggcccagctcttcggcggtgaagccggcaagcccctcgacggatgctaccaccaggcctgcgacgacatcaacaaccttgcccacgacgcctacctcctcaacacccagagcattgccaactccgttgccaagtacgccgtctctttcgagggtatccccaaggccaacgctactctccgcaaacgcggtgctgagtcggcaaggttcatgagcaggttcgaccacggtggccatgagcaccttggtcagccttgcggtgctggaaagcacgctatt

SEQ ID NO: 223 - protein, 518 aa, Cochliobolus heterostrophus strain C4 (ATCC 48331); identical to SEQ ID NO: 221
  SIGNAL (1)...(15)
  DOMAIN (234)...(471): Peptidase family M28
  DOMAIN (115)...(224): PA (protease associate) domain

SEQ ID NO: 224 - DNA, 3377 bp, Cochliobolus heterostrophus strain C4 (ATCC 48331)
  CDS (1001)...(1321): Exon
  CDS (1379)...(1536): Exon
  CDS (1589)...(1694): Exon
  CDS (1745)...(2377): Exon
caagactcaactgcaaaggatcagcttttgctgtttaaatgctaccttgggtagctttcatgtttgaggaacgaaaaaatagtattgaccggaacgtgtatttagtcccgaatcgtccagaacaatgcaactacaaaagcatgccacaaggtataagcagtgtggttttcggatatctggaatcgtttgcataagagatgagaaaaagagacaagggcgaagtttcacggaactctttggccgtaaagcgatcaaaattgcatatggttagttttggcctataaagtgaattttctcacagcatgcctagctctatcaattgctacctaaaacctgagcgctggccaaaaaacgacaaaatcatttctctgattggctcgttctaaggcagtaatactaactgttctccagactttgtctagatatggtttagggtagagcgcaggcccccatgctccttggcccttcaacataaccgactccagggaggtttacatcgactgatattcgttctcagagcgctgaaacgtcatagatcctcttgtagactgccttttttaattacaaaactactggcatagatcttccgagacttgattcagccgcgaaagctccaacacaggcccacaaaacgcgatgctggttcccgagacccgtcgcttcccatactactacggttaaggcgctcaaattggcaagcgttggccgagagaacagggatttccgccttcccacattcctattatttcctaaataccccttacgcaattccttggccacccatgactcggaggattttattaagctatacgaatattgttgcagatcctatgcccaaacaggcagaagttaagaaacaacaagacctgcttggatgtgggactttttttcaattacaatggtctatgcgacaacggccatgatgcaattcaaaaagtgtgtctagtccagcagtgttgggcaagccgcctctgttccacacgccttgccttcgttcacaatgcgcttcttcactcgtttcaccgcgctagtcacagccgcagctccgttcattgctcttgctgctcccgtcgcagcacctccagagaatgacataattcctggaaaatacatagtccagctgaagcctgataccgatgtcgcagcggtcgctgcccaccatcacaaagtgcgcagcatccatgcccgcaacctggcccgacgaggtgacaattctccgactggtgagccagtggagcgcgagtacgggttcggcgacttcaaaggctattctgggtttttcgatgaagcaaccatcgaagagttgaaaactctgccagaggtaatacaggccccttcatacaatgtcacaacctagcaatgctgatataattgttaggtgcttgtagttgagccagattttatcatgaggacttccgcaattgtgtctcaggcaagcccaccatggggcctcgctagtatctcctcccgcacaccaggagctgcctcttatgtctacgacgacagtgcgggccaaggcaccttttcctacgtgataggtaagtcaaaaacatagtgtagatcttgatttggtgttgacatattatcaagacacgggtgtgcgcatcacccaccaggactttggcggacgagccatctggggatttaatgccgtaagaaacagtcctgatactgatgaagatggccatggaacgtaagccacacttcatctcacagtggcaatactcttctgacataaactagtcacgttgctggaaccgttggcggtaccaaatatggtgttgccaagaaaaccaccatcataagtgtcaagaccttcggtggtagctcaggaagtgcatcagatgtcttcgcagggttcgactggacggtcaacgatatcgtttccaagaaccgacaaaacattgccgtcatcaatatgtcgttcggtggatctgcctctacaacgtgggacaatgccattactgcagcttggaacaaaggggtaagcatggtcgtagcagcaggaaacgaagacggacccacatccaatcgctcgccagcccgctctcccgaagccatctgtgtcgggaacgtccagagcaacaacagaaggctcagcggtggaggaggctccaactacggccctgaagtggatatcttcgctgcaggcaccctcatcgtctccgcatcccatctgagcgacacaggaacaaccactaagaacggtacttccatggcggctcctcacgtagctggtctgatctcataccttcgtggccttgagggtccctcgactgcggcggccattaaggcgagggtgtatcaactggccacgcctggtgtcgtgacagacgcaatgggctcagtcaatctactggcatacaacggtaacaaataatcgcatttctcatgaacgaggatcctagaattgcggtaatctacgattttatgattgggatgtaatctacttccttgcctgggctcttttctgtatatattatgtgttgaataactaccaattatccgattttatccaagtcactttcaatgcttcaaagttgtagtatgacttgtttagactaacctgtaatgttctagaagtcacgctgtctaccaatccaactcgaactcgacagtgatcggcaaggcttcgtaaaacacaagctcttgaacgaagggaacacaagcgttcatttttttactactcgtctcgaatcgattccttcacaatgttattgaaaggaacaactagctcacagatgagttacaaagcatctcaagatatcgataattcttcaaaatctcatattagtaggtgagcaatacattgccatgttcccacttggtaaaggttgacttttacgaaaggtatacttagcagcttggcgccgtcaaaaaatgtcaacaccaaccggacatgtcgaatgatccacttccaagtccaccaagacggagcaagtccgatctatcctgccgtgaactccagaaaacgtgtacgatcatcggggatgatgcaaggtccatccttgtgtcaagagacactcgctgtgcagagacagcttctaatccgtacttcctgaatcttttacctatagatcttccaagctttcggtaatataataaagttctaccgtcttctcttcttcagaaatcaagtctccagaaagcaccattgcaatgttggacttgttatcgatcgttgctcgatgcggggcgccaacatcaacatccagagtgtaatgcatggcagcgcactacacgcagctacatattggggcgaaaaatgcaaagctggagcttctaatgtcaaaattcgatatcaagcagctccaagatccgtacaaccagactctactctcgtaggctgcaggcggtggccagcctcatactgctaa

SEQ ID NO: 225 - protein, 107 aa, Cochliobolus heterostrophus strain C4 (ATCC 48331)
MRFFTRFTALVTAAAPFIALAAPVAAPPENDIIPGKYIVQLKPDTDVAAVAAHHHKVRSIHARNLARRGDNSPTGEPVEREYGFGDFKGYSGFFDEATIEELKTLPE

SEQ ID NO: 226 - protein, 53 aa, Cochliobolus heterostrophus strain C4 (ATCC 48331)
VLVVEPDFIMRTSAIVSQASPPWGLASISSRTPGAASYVYDDSAGQGTFSYVI

SEQ ID NO: 227 - protein, 35 aa, Cochliobolus heterostrophus strain C4 (ATCC 48331)
DTGVRITHQDFGGRAIWGFNAVRNSPDTDEDGHGT

SEQ ID NO: 228 - protein, 211 aa, Cochliobolus heterostrophus strain C4 (ATCC 48331)
HVAGTVGGTKYGVAKKTTIISVKTFGGSSGSASDVFAGFDWTVNDIVSKNRQNIAVINMSFGGSASTTWDNAITAAWNKGVSMVVAAGNEDGPTSNRSPARSPEAICVGNVQSNNRRLSGGGGSNYGPEVDIFAAGTLIVSASHLSDTGTTTKNGTSMAAPHVAGLISYLRGLEGPSTAAAIKARVYQLATPGVVTDAMGSVNLLAYNGNK

SEQ ID NO: 229 - DNA, 1218 bp, Cochliobolus heterostrophus strain C4 (ATCC 48331)
  CDS (1)...(1218)
atgcgcttcttcactcgtttcaccgcgctagtcacagccgcagctccgttcattgctcttgctgctcccgtcgcagcacctccagagaatgacataattcctggaaaatacatagtccagctgaagcctgataccgatgtcgcagcggtcgctgcccaccatcacaaagtgcgcagcatccatgcccgcaacctggcccgacgaggtgacaattctccgactggtgagccagtggagcgcgagtacgggttcggcgacttcaaaggctattctgggtttttcgatgaagcaaccatcgaagagttgaaaactctgccagaggtgcttgtagttgagccagattttatcatgaggacttccgcaattgtgtctcaggcaagcccaccatggggcctcgctagtatctcctcccgcacaccaggagctgcctcttatgtctacgacgacagtgcgggccaaggcaccttttcctacgtgatagacacgggtgtgcgcatcacccaccaggactttggcggacgagccatctggggatttaatgccgtaagaaacagtcctgatactgatgaagatggccatggaacgcacgttgctggaaccgttggcggtaccaaatatggtgttgccaagaaaaccaccatcataagtgtcaagaccttcggtggtagctcaggaagtgcatcagatgtcttcgcagggttcgactggacggtcaacgatatcgtttccaagaaccgacaaaacattgccgtcatcaatatgtcgttcggtggatctgcctctacaacgtgggacaatgccattactgcagcttggaacaaaggggtaagcatggtcgtagcagcaggaaacgaagacggacccacatccaatcgctcgccagcccgctctcccgaagccatctgtgtcgggaacgtccagagcaacaacagaaggctcagcggtggaggaggctccaactacggccctgaagtggatatcttcgctgcaggcaccctcatcgtctccgcatcccatctgagcgacacaggaacaaccactaagaacggtacttccatggcggctcctcacgtagctggtctgatctcataccttcgtggccttgagggtccctcgactgcggcggccattaaggcgagggtgtatcaactggccacgcctggtgtcgtgacagacgcaatgggctcagtcaatctactggcatacaacggtaacaaa

SEQ ID NO: 230 - protein, 406 aa, Cochliobolus heterostrophus strain C4 (ATCC 48331)
  SIGNAL (1)...(21)
  DOMAIN (35)...(120): Subtilisin N-terminal region
  DOMAIN (134)...(397): Subtilase family
MRFFTRFTALVTAAAPFIALAAPVAAPPENDIIPGKYIVQLKPDTDVAAVAAHHHKVRSIHARNLARRGDNSPTGEPVEREYGFGDFKGYSGFFDEATIEELKTLPEVLVVEPDFIMRTSAIVSQASPPWGLASISSRTPGAASYVYDDSAGQGTFSYVIDTGVRITHQDFGGRAIWGFNAVRNSPDTDEDGHGTHVAGTVGGTKYGVAKKTTIISVKTFGGSSGSASDVFAGFDWTVNDIVSKNRQNIAVINMSFGGSASTTWDNAITAAWNKGVSMVVAAGNEDGPTSNRSPARSPEAICVGNVQSNNRRLSGGGGSNYGPEVDIFAAGTLIVSASHLSDTGTTTKNGTSMAAPHVAGLISYLRGLEGPSTAAAIKARVYQLATPGVVTDAMGSVNLLAYNGNK

SEQ ID NO: 231 - DNA, 3206 bp, Cochliobolus heterostrophus strain C4 (ATCC 48331)
  CDS (883)...(948): Exon
  CDS (1010)...(3106): Exon
caagatctccttcgcatgcccaatatccatacatatgtatagaagacaaggatcgattccatatgtatagaaggagctgcaatgtgggtattaaatgcgatatgggacgacggctcagccgtaggtgtaatatgctgacacgaaaatacagtcgaatcgagccagatctaggcctggcaaggcaggtatagatgtcaatctgctcacggacatgttaggcgtgcaaaaggcccaagccagaccaaggatgccaagaaatatcatgcagtcccgccctctcaattccgcgaggatgcattccagcagccagccagcgccgtggatgtggaggatctatgtgtaacctcatgttggactttttttcgacctgcctttttgggtgcaccgtttatccgccacaaattagttggtgattagcgtgagctgtgggcatgcgccaccaatcgcgatgtgggcttggtggagctactacacaccaaagatacccacccataaacgccaagtcagtccatccagcgactctcaagtggaccaagttgcgataggacgacacggaaacatgctttctggcaatccacctaggacgagcttgtttttgtccccgcgcatctagccctgatcgggcaggagacatggtgcaaaacgtctatcttttgacgtctatggactagtcgctactgcattgcctatggaatgatggcatcgtcacttcaggtacccgtcccgaaaggacgtggcccactgcctggatggcgacatgccctgcggcaggggcctcgggcttagctctttgtacaaataattcggatgccctgcatggccttcttctggtcatcgacctcgtccaattgagcttttacgaagctggtcgcatactgcacaatggctcgttacctcagtgttgccgcagcactggctgctactggcgcgtgcgcgttcacacccgagtgcgtcttttgtcccctacagctacatgctcccgatgacggcaagctaataaacatacaggttgcttcttagcaccgtacgacgcgctgccgccgatcccagtccagatggctcagtcgcgctcttctcgtacacgcagtactccttcgaggaacatgcgcgcacggctggcatgaacctcatcgatctcaagaccggtgaggtcaccaagtcgggcctcgaccccagcgaggtcaacgaagtggcctggattcctggcaccgagaccggtatcatctacatcaatggcacaaacgaggaaatcccaggtggtgtcaccctgtggattggtgacatcaaggacccaagcgccagcactcttgttgcctccctggatgcaccatactccggcttgaaggttgccaacacctctactggtgacttgcatttcttggtcaacagcttggcctaccccaacggcactgcagttaaccccgagaccgaagtcaagccaacttcaactgcccgttactactcggatatctatgtccgccactgggatacctggctaactaagaaccgctaccagctttttgctggtacactttccaagaacagcagttatgctctctctggcgctggcgtgcgcaacatccaaagtggtatcaaattcaccgctactcagcctgagactcccgtccagccttttggcgactcgagcgattatgacatcagtcccgatggctctatgtatgctttcattagcaaggctcctcagctcaacaaggccaactacaccgcgtcctacctatacgtcggtgcctttgcctccaacgaagctcccgttgctctcaacggccctgactctgaggctttcaaggctggacaccagggtgcttccggtctaccatccttctccggtgacagctgcaagcttgcatatgtccaacaagacgaggactactatgagtcggacaggttcaagctgtacacctacgacgttgctgtcgagggccaaggcgtggccgctagcaactggaagagcttgagcgaaggttttgaccgctgggtgcaaggtcccattacttgggctcacgacgattcttcaatctacgtcactgctgatgactacgcccgcaacaagatcttcaacttcccaatcaccgcggatgagaagtttgttcccgagccgctaactggaaacacttcagtttcggcgttttctctgcttcctgacggttcgctgttcgttgcagccaccgctatctggactcccaacgaatggtacatcctcgccgacggcaacaagaagacgcttcttgacgcttcccaggttgaccccaacctggccggtctcagctccaagactgtctctgagattttcttcaatggctccaaccccgatctcaagcaacaacttcaggcttatgtcgtcaagcccacattctaccaagagaacgttacttacccccttgctttcctgattcacggtggtcctcagggcaactggggcaacagctggtcaaaccgctggaacccgcaggtctgggccgaccaaggctacatcgtcgtcgcacctaacccgactggttctacaagtttcggacagtacctcatcgactccatccagggcgagtggggcagctggccatacgaagacctggtcaatgcctggaactacatcaactccaccatgacgtggatcgacaccgagaacggtatcgccgccggtgcctcgtacggtggatacatgaccaactggatccagtccaatgacctcggcaacgagttcaaggctctcgtcacccatgacggtatctccaacaccgagggtgcctgggcgtccgaggagctctggttcatccgccacgactacgatggcaacatctgggactcacccgcctaccgccagtggaacccccagaaccacattgccaactggtccactccccagttcgtcatccacaacacgctcgactaccgtctccccgagagcgacggcatcagcctgttcaacatcctccaggcgcgcggtatccccagtcgcttcctcaacttccccgacgagaaccactgggtcctcaagcaggagaacagcttggtttggcacactgagattttcaactggatcaaccactggtccaagggtgagcctttgagcactaccccgattggcaactaaaaatatttttccgagtaggaattagccaaagtagcaagataacgcttgctacgtagtattgataaatgtctaatgatacctattgagaaccacttta

SEQ ID NO: 232 - protein, 22 aa, Cochliobolus heterostrophus strain C4 (ATCC 48331)
MARYLSVAAALAATGACAFTPE

SEQ ID NO: 233 - protein, 699 aa, Cochliobolus heterostrophus strain C4 (ATCC 48331)
LLLSTVRRAAADPSPDGSVALFSYTQYSFEEHARTAGMNLIDLKTGEVTKSGLDPSEVNEVAWIPGTETGIIYINGTNEEIPGGVTLWIGDIKDPSASTLVASLDAPYSGLKVANTSTGDLHFLVNSLAYPNGTAVNPETEVKPTSTARYYSDIYVRHWDTWLTKNRYQLFAGTLSKNSSYALSGAGVRNIQSGIKFTATQPETPVQPFGDSSDYDISPDGSMYAFISKAPQLNKANYTASYLYVGAFASNEAPVALNGPDSEAFKAGHQGASGLPSFSGDSCKLAYVQQDEDYYESDRFKLYTYDVAVEGQGVAASNWKSLSEGFDRWVQGPITWAHDDSSIYVTADDYARNKIFNFPITADEKFVPEPLTGNTSVSAFSLLPDGSLFVAATAIWTPNEWYILADGNKKTLLDASQVDPNLAGLSSKTVSEIFFNGSNPDLKQQLQAYVVKPTFYQENVTYPLAFLIHGGPQGNWGNSWSNRWNPQVWADQGYIVVAPNPTGSTSFGQYLIDSIQGEWGSWPYEDLVNAWNYINSTMTWIDTENGIAAGASYGGYMTNWIQSNDLGNEFKALVTHDGISNTEGAWASEELWFIRHDYDGNIWDSPAYRQWNPQNHIANWSTPQFVIHNTLDYRLPESDGISLFNILQARGIPSRFLNFPDENHWVLKQENSLVWHTEIFNWINHWSKGEPLSTTPIGN

SEQ ID NO: 234 - DNA, 2163 bp, Cochliobolus heterostrophus strain C4 (ATCC 48331)
  CDS (1)...(2163)
atggctcgttacctcagtgttgccgcagcactggctgctactggcgcgtgcgcgttcacacccgagttgcttcttagcaccgtacgacgcgctgccgccgatcccagtccagatggctcagtcgcgctcttctcgtacacgcagtactccttcgaggaacatgcgcgcacggctggcatgaacctcatcgatctcaagaccggtgaggtcaccaagtcgggcctcgaccccagcgaggtcaacgaagtggcctggattcctggcaccgagaccggtatcatctacatcaatggcacaaacgaggaaatcccaggtggtgtcaccctgtggattggtgacatcaaggacccaagcgccagcactcttgttgcctccctggatgcaccatactccggcttgaaggttgccaacacctctactggtgacttgcatttcttggtcaacagcttggcctaccccaacggcactgcagttaaccccgagaccgaagtcaagccaacttcaactgcccgttactactcggatatctatgtccgccactgggatacctggctaactaagaaccgctaccagctttttgctggtacactttccaagaacagcagttatgctctctctggcgctggcgtgcgcaacatccaaagtggtatcaaattcaccgctactcagcctgagactcccgtccagccttttggcgactcgagcgattatgacatcagtcccgatggctctatgtatgctttcattagcaaggctcctcagctcaacaaggccaactacaccgcgtcctacctatacgtcggtgcctttgcctccaacgaagctcccgttgctctcaacggccctgactctgaggctttcaaggctggacaccagggtgcttccggtctaccatccttctccggtgacagctgcaagcttgcatatgtccaacaagacgaggactactatgagtcggacaggttcaagctgtacacctacgacgttgctgtcgagggccaaggcgtggccgctagcaactggaagagcttgagcgaaggttttgaccgctgggtgcaaggtcccattacttgggctcacgacgattcttcaatctacgtcactgctgatgactacgcccgcaacaagatcttcaacttcccaatcaccgcggatgagaagtttgttcccgagccgctaactggaaacacttcagtttcggcgttttctctgcttcctgacggttcgctgttcgttgcagccaccgctatctggactcccaacgaatggtacatcctcgccgacggcaacaagaagacgcttcttgacgcttcccaggttgaccccaacctggccggtctcagctccaagactgtctctgagattttcttcaatggctccaaccccgatctcaagcaacaacttcaggcttatgtcgtcaagcccacattctaccaagagaacgttacttacccccttgctttcctgattcacggtggtcctcagggcaactggggcaacagctggtcaaaccgctggaacccgcaggtctgggccgaccaaggctacatcgtcgtcgcacctaacccgactggttctacaagtttcggacagtacctcatcgactccatccagggcgagtggggcagctggccatacgaagacctggtcaatgcctggaactacatcaactccaccatgacgtggatcgacaccgagaacggtatcgccgccggtgcctcgtacggtggatacatgaccaactggatccagtccaatgacctcggcaacgagttcaaggctctcgtcacccatgacggtatctccaacaccgagggtgcctgggcgtccgaggagctctggttcatccgccacgactacgatggcaacatctgggactcacccgcctaccgccagtggaacccccagaaccacattgccaactggtccactccccagttcgtcatccacaacacgctcgactaccgtctccccgagagcgacggcatcagcctgttcaacatcctccaggcgcgcggtatccccagtcgcttcctcaacttccccgacgagaaccactgggtcctcaagcaggagaacagcttggtttggcacactgagattttcaactggatcaaccactggtccaagggtgagcctttgagcactaccccgattggcaac

SEQ ID NO: 235 - protein, 721 aa, Cochliobolus heterostrophus strain C4 (ATCC 48331)
MARYLSVAAALAATGACAFTPELLLSTVRRAAADPSPDGSVALFSYTQYSFEEHARTAGMNLIDLKTGEVTKSGLDPSEVNEVAWIPGTETGIIYINGTNEEIPGGVTLWIGDIKDPSASTLVASLDAPYSGLKVANTSTGDLHFLVNSLAYPNGTAVNPETEVKPTSTARYYSDIYVRHWDTWLTKNRYQLFAGTLSKNSSYALSGAGVRNIQSGIKFTATQPETPVQPFGDSSDYDISPDGSMYAFISKAPQLNKANYTASYLYVGAFASNEAPVALNGPDSEAFKAGHQGASGLPSFSGDSCKLAYVQQDEDYYESDRFKLYTYDVAVEGQGVAASNWKSLSEGFDRWVQGPITWAHDDSSIYVTADDYARNKIFNFPITADEKFVPEPLTGNTSVSAFSLLPDGSLFVAATAIWTPNEWYILADGNKKTLLDASQVDPNLAGLSSKTVSEIFFNGSNPDLKQQLQAYVVKPTFYQENVTYPLAFLIHGGPQGNWGNSWSNRWNPQVWADQGYIVVAPNPTGSTSFGQYLIDSIQGEWGSWPYEDLVNAWNYINSTMTWIDTENGIAAGASYGGYMTNWIQSNDLGNEFKALVTHDGISNTEGAWASEELWFIRHDYDGNIWDSPAYRQWNPQNHIANWSTPQFVIHNTLDYRLPESDGISLFNILQARGIPSRFLNFPDENHWVLKQENSLVWHTEIFNWINHWSKGEPLSTTPIGN

SEQ ID NO: 236 - DNA, 3434 bp, Cochliobolus heterostrophus strain C4 (ATCC 48331)
  CDS (1001)...(1318): Exon
  CDS (1382)...(1645): Exon
  CDS (1711)...(1887): Exon
  CDS (1940)...(2437): Exon
  misc_feature (1)...(3434): n = A,T,C or G
gctggcaggcgcggttttcaacaccgtggcgcagtttggtatgagtttgggcatggggagttgtcaggttgtggcgctgggggtgcagggtcctgctagtggcagtactggcgagggacatgcaagtggacatggtggggggagtgcatttgaggataaggatgagggtgcggtactgaaggggtatagggcgagttattggctcatgtttgggtatatggtggtgtgcatggggattgcggttgtggggttgaggaaggcgggtaaggttgggctgaagaaggagtgaaaggactagatgttttgcccttgtgtattctgctaccatgtcgtatgtaatactagcatctacctcgcacgcagcactttcagcaccttctcagcccacatcctgacaccgatccgtactccacagctacacccggtccctccatcgccaaaggggaaggtcgcatgccgcctcaccgatcgcgtcaccggtaccattccatcttccacagcatacttatgggcccacacgtacagtatccccgcaagtcattcgcacatcgcaggcgtagcctacatgttgcgcgttacccaatgtggcagttggctggtctgccaaggcgcaaatcccctgcagatcaccatctaggcacataaggcttgagctggaccacccaggcttatctcgcagcaagcaacgatattaactacctgcccgccatgtcgacccaatacctacacagaatatggcagaccagcttcccaagcaaggttgctgccccggccagcggccaaggccagtcgggcaggtgtgagggaatggtaggctgtccaaggcccaatgtggaatgaagccgtcgtactgcatcggcgggcatgtacttttgtcatgagagcaatttgactttgtttcgaggcgattatatattagagggtaggcgaagcctgagaatgttctttcctcaggccacgcttctccctctcacctttctctgtcttcaatcttgtagccatgaagctcctcagcgtcaccctggcctcgctgggcctcgcctccgccgccaccgttgccaagaaagtgacctacgacgactggaaggtcgtccgtgtcaatgtcggcgcagacgctgctaagctcgaaaatgtaatgagcaagctgcagcttgagctgtggaagggcaagcctgcgtcaagcgatgtcgtcgatgttatggtgccgccgtcgtcggtcaaggactttgaggctcagactcagggtttcgaaacaaaagtcatgcatgagaatcttggcctttctatcgcagacgagcagagttttggcacatatgccggtacgcttgttttccccgccctgtaaattgaagaggtgacatgggaagtcctaactctgtcagctggtcttgcaccaaactcgacgtggtttaactcctaccactccattgctgatcacatgcaatggattagcgatcttgcggctgcataccccaagaacgcagaagtcatttctgcaggcaagtcggttgagggccgtgatatcaagggtatccacatctggggtagtggtggtaagggatctcagaagggtgtagtatggcacggcactgtgcacgcacgtgaatggatcacgacaatggtaaattcccttttcaaaaaaaaaaacaggaacaaaggaaaggaagaattgtgctaacacacttacaggtggtcgaatatgcagcataccaactccttacctccactgacgccacaaccgccggcttcaaagactcgtacgacttctacatcttccccatcgtcaacccagatggcttcgcctacagtcagaccaccgaccgcatgtggcgcaagaaccgccagactactcccagcgcctcatgcgtaggccgggacatcaaccgtaagttctctcccgtccccccaagcatatatacatctaaccgatcatcaaggcaactggccctctcactggaaccaggccaacggtgcctccacctcgccctgcgaccaagactacaaaggcccctcagccggcgacggcgtagaaaccaaagccctgaaagcgcacctcgacagcatcgccgccggcaaaggcataaccctctacatggacatccacgcctacagccaactctggatgtacccctacggctacacctgctccggcgctctccccaactccgcaaagtactcttcgctgaccaacggtgccattgccgcggtcaaggcagtgcatggaacggcgttcacgggcggcccgatttgcaataccatctatcaggttagtggcgatagtgtggattatgcgtttgaggtcgcaaaggcgacgtatagtatgacggtcgagttgagggatacgggtaagtatgggtttgtcctgccgaaagagcagattgtgccgagtgccgaggagatgtgggctggtttgaggtacttggtgaagaatatgtaaggtggtagaggggaatatatgtatatacgagtgtggggatgtattttttttgttgggctggggggcttctggaagattttgagttggcggggggagccccattgtagatatattttctagaggatgaaaaatcttgagagcagagagagagagaattggcgttaaaaaaggtcttttgaggaaggggttgcctttcttatttctgtgatcttgatgatacgaggagaggagagaaagaagaaaaggaagacacaactatgactgcccaatacacccttgaagaaaccctgaagaatggagtggtaatagtaccaaaaagtgtgtacacctcttgaaaggtatgcacctatcaggtacgataatcaaattaatcatgattgcgatgaacgtaactgaatagcaaactatggttgcaacaaggacacgcagtgcagcaaagcattccaatcaatgcctataaattcgcaatatcttccgtctatctctcccatcttatcaccagccacaaattcattggacctccatatctcctcctaccaacgcaacatctcccttccattcctgcctcctatccgtatttcctcttcaccaaccaccaatcaagccgcttacatctcttaaaaaaccactataccattcctctccaccaccacataagaacagcaacaacaaaaaatcaagcnnnnnnnnnnnnnnnnnnnnaccctcctcaccctcaccacccgcaccctctgctccctccaacaccccaccaacctccccccatgcaccgtttccaacctaggccagaccctctgccgcaccacacccagcgacagctacatcttccagtgcaacgccgcgaccctccactggcacgtcatgcggacatgcacgtcggccaacgcgccctgctccaacacgacctgcacgcctctcacagacgcctgcgtagaatcctccacgcaatgcgcgacactgctctcgcacggctacaacggcatcgccgtgtgccgcg

SEQ ID NO: 237 - protein, 106 aa, Cochliobolus heterostrophus strain C4 (ATCC 48331)
MKLLSVTLASLGLASAATVAKKVTYDDWKVVRVNVGADAAKLENVMSKLQLELWKGKPASSDVVDVMVPPSSVKDFEAQTQGFETKVMHENLGLSIADEQSFGTYA

SEQ ID NO: 238 - protein, 88 aa, Cochliobolus heterostrophus strain C4 (ATCC 48331)
AGLAPNSTWFNSYHSIADHMQWISDLAAAYPKNAEVISAGKSVEGRDIKGIHIWGSGGKGSQKGVVWHGTVHAREWITTMVNSLFKKK

SEQ ID NO: 239 - protein, 59 aa, Cochliobolus heterostrophus strain C4 (ATCC 48331)
QLLTSTDATTAGFKDSYDFYIFPIVNPDGFAYSQTTDRMWRKNRQTTPSASCVGRDINR

SEQ ID NO: 240 - protein, 165 aa, Cochliobolus heterostrophus strain C4 (ATCC 48331)
NWPSHWNQANGASTSPCDQDYKGPSAGDGVETKALKAHLDSIAAGKGITLYMDIHAYSQLWMYPYGYTCSGALPNSAKYSSLTNGAIAAVKAVHGTAFTGGPICNTIYQVSGDSVDYAFEVAKATYSMTVELRDTGKYGFVLPKEQIVPSAEEMWAGLRYLVKNM

SEQ ID NO: 241 - DNA, 1254 bp, Cochliobolus heterostrophus strain C4 (ATCC 48331)
  CDS (1)...(1254)
atgaagctcctcagcgtcaccctggcctcgctgggcctcgcctccgccgccaccgttgccaagaaagtgacctacgacgactggaaggtcgtccgtgtcaatgtcggcgcagacgctgctaagctcgaaaatgtaatgagcaagctgcagcttgagctgtggaagggcaagcctgcgtcaagcgatgtcgtcgatgttatggtgccgccgtcgtcggtcaaggactttgaggctcagactcagggtttcgaaacaaaagtcatgcatgagaatcttggcctttctatcgcagacgagcagagttttggcacatatgccgctggtcttgcaccaaactcgacgtggtttaactcctaccactccattgctgatcacatgcaatggattagcgatcttgcggctgcataccccaagaacgcagaagtcatttctgcaggcaagtcggttgagggccgtgatatcaagggtatccacatctggggtagtggtggtaagggatctcagaagggtgtagtatggcacggcactgtgcacgcacgtgaatggatcacgacaatggtaaattcccttttcaaaaaaaaacaactccttacctccactgacgccacaaccgccggcttcaaagactcgtacgacttctacatcttccccatcgtcaacccagatggcttcgcctacagtcagaccaccgaccgcatgtggcgcaagaaccgccagactactcccagcgcctcatgcgtaggccgggacatcaaccgtaactggccctctcactggaaccaggccaacggtgcctccacctcgccctgcgaccaagactacaaaggcccctcagccggcgacggcgtagaaaccaaagccctgaaagcgcacctcgacagcatcgccgccggcaaaggcataaccctctacatggacatccacgcctacagccaactctggatgtacccctacggctacacctgctccggcgctctccccaactccgcaaagtactcttcgctgaccaacggtgccattgccgcggtcaaggcagtgcatggaacggcgttcacgggcggcccgatttgcaataccatctatcaggttagtggcgatagtgtggattatgcgtttgaggtcgcaaaggcgacgtatagtatgacggtcgagttgagggatacgggtaagtatgggtttgtcctgccgaaagagcagattgtgccgagtgccgaggagatgtgggctggtttgaggtacttggtgaagaatatg

SEQ ID NO: 242 - protein, 418 aa, Cochliobolus heterostrophus strain C4 (ATCC 48331)
  SIGNAL (1)...(20)
  DOMAIN (117)...(321): Zinc carboxypeptidase
MKLLSVTLASLGLASAATVAKKVTYDDWKVVRVNVGADAAKLENVMSKLQLELWKGKPASSDVVDVMVPPSSVKDFEAQTQGFETKVMHENLGLSIADEQSFGTYAAGLAPNSTWFNSYHSIADHMQWISDLAAAYPKNAEVISAGKSVEGRDIKGIHIWGSGGKGSQKGVVWHGTVHAREWITTMVNSLFKKKQLLTSTDATTAGFKDSYDFYIFPIVNPDGFAYSQTTDRMWRKNRQTTPSASCVGRDINRNWPSHWNQANGASTSPCDQDYKGPSAGDGVETKALKAHLDSIAAGKGITLYMDIHAYSQLWMYPYGYTCSGALPNSAKYSSLTNGAIAAVKAVHGTAFTGGPICNTIYQVSGDSVDYAFEVAKATYSMTVELRDTGKYGFVLPKEQIVPSAEEMWAGLRYLVKNM

SEQ ID NO: 243 - DNA, 4594 bp, Cochliobolus heterostrophus strain C4 (ATCC 48331)
  CDS (1692)...(1873): Exon
  CDS (2057)...(2509): Exon
  CDS (2593)...(2768): Exon
  CDS (2834)...(3597): Exon
agacttggcgcgcaacaccgagtttcggaacgctgtcctcgatgctatgaaccacataaaagttcttcatccaaatggagccgaagacagaattacgcaaggtcctctttccaacgatgactcccgcacacctgttctggaacgggtcagagacgccgaagttgaggtatttgcccggaaccgaaagcgtctggtcctcgatcttgaaggtgaaatctggcagtgtggcgttgcatgggaaggtattactaccgccaagtgtcaactcgtagtctggaacctgactgtagtagttggcgacgaccggatcagggaggtagatgagcggagaaccagagtcgacagtggtattaccgatgatggccggtccaaaggttttgttgcccgcgccatactctccaactgctatggtccaatgcttcatgttgtcgaccacaggcgtatatgtgatgtcgccagtgtatttggatttgtcgagatagccaaagtcccaagaaccattgccctcgggcctcaagtttgctgcaaagacttttttcttcagtgtcggtgcgacggtttcgaagaaggtgctttgttgcacaggctttacctggttgatgatgccgaacgcaagacccatgataccatccgagtcgatatcgctggggacataggttgctacctcgacggcttgcttctcggccacaaccgggccagccttgaccacatccgtgtaaacaatgccattggccgaggagccgcctgagtaggtgatggtccaattatagttgggcaacagctgtgcagacgacgatgggaagtagtaggttttgtccggaccctgcatagttgatgtctcgttgccaaacacccacaagtcggcggagccagtatcgtaaatcaggttgaaagtctgatttccaataatggtaggggtaaagtaggtgatgccagggtcgtcgggcactacagtgacggacccttcctgttggcctgcaacattggcttgtctcttgtcgacagtttccgtggtaggatgccttgagcgaagttttcgaaagtcggcctcaaaatcaaatgatggcggagcggctgctacggcgtcgacactataggcagcgccgcgaggttctggtacaagagcgcaggcagaagaggcgagtatggcgagtgcgagcttggctgtcatgctttgcaaatgtgacattgtgtttgtgtgaatagtagagagaagatggtggagtaaagagggtgtcacccggcaaatgctgtgtagccaaataatgcggaataaactttaattttgtagaggcatttatctgtctgtcgagctgacctcacgttagcatgtgtagcagatgtaaggccgacaatcttacacggcaacaatggatacctctgcccagggcacactgcgaacactggacctttgggctaaatgttgattgggtaaagtaagagtgatttggagtcgaggcggtctacaaccctagcggtacttgggtgcaagctagtatatggcatgatgtcaacaaggtcgtattgagaagcaaagacgatgagttcacaggggaggttgaccgaaatagcaaaaacgatgtatgcattgcccatcccggtagtctataaaaagtaagagcttgcttgacgtgggaaatggggtgccgatccagagcgtgcattaatgtgaaagtggactaggagagaagatggcgccaatcaagttggtcgggtggaaatggcggactggctggccggggataattcggctagcgggctgggagaggaaggagctcgtgttgacacgatgcagcgtccactttggcatccatgaaacacgcatccgatatattgttctccaaaaaccgggacccccgcaaacccacaagccgtcaagataagtacacacctgcacaacggcaaagacaaggtacagtggtccgtgccacacacacagcatagccaaactcaaatccatcgtactcgtattgctacattcccggcacggcccgactcagtcagtagccaacttaccatgtagcgttgtaataagctttggccactctcttggcagtgcatacgctctggagatcacagtcgaccgtccacaccccacactcaggagtgccctgggtcggtcagccgagagacaggcatctggtactcacataaagacctgccatggctccgtcttcccttgccttgcccgcatctgcgcaatcttgctctcacactcaacaatcatgcctgattccaagatggtctcacgcgcccttctcgccgcccttgcactccctgctgtctctgccgagcttcccccaggcgccattgctgtgcccctgatccgagacgccgaactcgacgcatactacgcagagttccaggtcggaacgcccccgcagaaggaatacctcaaagtcgatactggcagcccacgatattcctttcttaacccgcgcaaccaagaatgtgtctcggatccagcgtcatgcactacttttggcacttttgacaacttgacctcttcgtaagtaatcatctttggcttctttttttattaaaaaaagaagcccccaaaaagattgcaagcgctaattctacatcttccagaacttgtcgttatgaaggacctggcttctacgatgaactctacgcattaggatttggcgattacctcagtgacaccttggtcctgggcggtgtcaccatgcccaacatgtatttcgggtacacgtccaattatacggccggaaaagtagttccagaaccaattcaaactattctgggtatgtcaagacacccgtgttcttcgtgcacgactgcagtctaactgtttgattgcgaaatctaggcctgtctctcgaatgttatccggaggagcctgactgcatgtccaaaggggcatattttctaccagagttgaagaacgcctcactgattgacgtcatggcaacaagtatgtaccttgggccggatgaattcaacgtcaccaatgcccagatgatcattggtggcgcctatgacaaggcaaaggtggacggtgacatgttcacgctggagatggtggatccattctccacactcaccggcgaacaaacgaactacgtgaacgtcactgcaatggaagttgtacttgacggcggcaaccgcacgtcacaaacctttggagataagggtgttggtgtccccatcttgctcgacacgggcattgcaacctggtacgtgactgataccattttcggcgccgtctcctacggattgggtattaccgccttccaacctggaaaacaggtgacctctgttgactgcaagtaccgggaccccaacaatgccaagggctacatctctgtcgaattcggcgctagtggcaagattgacgttccgctgcacgaaattatctctctgtttgctaatagcacgtgtggcgtctacatggagcctcgctcggaaaccgatattggcgtactcgcagacccctttattcgtgcaatttacgcaatcttcgaccagacccacaggaccatcacaatgggcaaagcaaaatacacaactgagcagaacattgtgcccttccccgagggaggtttcacagtgggctccaaggtcagctcttagacacggcacatgtatatatttgtaatccggttagaatgtacatattcaagttgggattgtgagatccaagcgctcttatgcaagaggaaacgcgacagatgatgtttaatgatgtcgtggttaccaatcttgacacattccaatgatgcatttcaactcgtaaagatttatttcaagttgttgaggccatatctacatttccatgatacataccaaagcgggtccactagaaatggacaacacagcagtgccaagaaaatgattacaacgaatacgagtcaagacactgaactctgtagtgaagattagtgctgacctttgttgataatggacatgaactacgttggcgctgcggggcggaatatccacatattaagagacatcttacctcccgtaataaggcttaattgatggtgcattacaagcccacctatgactcttgtctggaagaaagtgcttagatttgcgctttagctgcaaaggctatttagtctgactgtactactcgttctatgtagcaagggtgcgtatggtaagtagatgtcgcgtgagaatcgcgctaacgtaacacggagatccctgtcaactaggtaaagagtgggagagcaagtggcagtagagtttggagctactagtatgtaaattctaattcttcgtgcaaccaaagccctggggggagcatggatacggggcaggtactgtgaacataatgtcgcaattatattcatcatgtcgttactatagccggcaatgaactgattaacaagcaaccccgcgatgatatcatcttatagctccccacccctcagtcaaccccatccattaacaccccagccatggcaacggtcagtgaggcggaggcgccacagcctaggaaggttgtctttgatctaccaactgcagatggtacatcccaagccaccgttactttacaagaaaatgaagatgccaccaaaccgcccctgctactcgacatcaccaaacgagctctcgaccc

SEQ ID NO: 244 - protein, 61 aa, Cochliobolus heterostrophus strain C4 (ATCC 48331)
MAPIKLVGWKWRTGWPGIIRLAGWERKELVLTRCSVHFGIHETRIRYIVLQKPGPPQTHKP

SEQ ID NO: 245 - protein, 151 aa, Cochliobolus heterostrophus strain C4 (ATCC 48331)
AYALEITVDRPHPTLRSALGRSAERQASGTHIKTCHGSVFPCLARICAILLSHSTIMPDSKMVSRALLAALALPAVSAELPPGAIAVPLIRDAELDAYYAEFQVGTPPQKEYLKVDTGSPRYSFLNPRNQECVSDPASCTTFGTFDNLTSS

SEQ ID NO: 246 - protein, 58 aa, Cochliobolus heterostrophus strain C4 (ATCC 48331)
TCRYEGPGFYDELYALGFGDYLSDTLVLGGVTMPNMYFGYTSNYTAGKVVPEPIQTIL

SEQ ID NO: 247 - protein, 254 aa, Cochliobolus heterostrophus strain C4 (ATCC 48331)
GLSLECYPEEPDCMSKGAYFLPELKNASLIDVMATSMYLGPDEFNVTNAQMIIGGAYDKAKVDGDMFTLEMVDPFSTLTGEQTNYVNVTAMEVVLDGGNRTSQTFGDKGVGVPILLDTGIATWYVTDTIFGAVSYGLGITAFQPGKQVTSVDCKYRDPNNAKGYISVEFGASGKIDVPLHEIISLFANSTCGVYMEPRSETDIGVLADPFIRAIYAIFDQTHRTITMGKAKYTTEQNIVPFPEGGFTVGSKVSS

SEQ ID NO: 248 - DNA, 1575 bp, Cochliobolus heterostrophus strain C4 (ATCC 48331)
  CDS (1)...(1575)
atggcgccaatcaagttggtcgggtggaaatggcggactggctggccggggataattcggctagcgggctgggagaggaaggagctcgtgttgacacgatgcagcgtccactttggcatccatgaaacacgcatccgatatattgttctccaaaaaccgggacccccgcaaacccacaagcctgcatacgctctggagatcacagtcgaccgtccacaccccacactcaggagtgccctgggtcggtcagccgagagacaggcatctggtactcacataaagacctgccatggctccgtcttcccttgccttgcccgcatctgcgcaatcttgctctcacactcaacaatcatgcctgattccaagatggtctcacgcgcccttctcgccgcccttgcactccctgctgtctctgccgagcttcccccaggcgccattgctgtgcccctgatccgagacgccgaactcgacgcatactacgcagagttccaggtcggaacgcccccgcagaaggaatacctcaaagtcgatactggcagcccacgatattcctttcttaacccgcgcaaccaagaatgtgtctcggatccagcgtcatgcactacttttggcacttttgacaacttgacctcttcaacttgtcgttatgaaggacctggcttctacgatgaactctacgcattaggatttggcgattacctcagtgacaccttggtcctgggcggtgtcaccatgcccaacatgtatttcgggtacacgtccaattatacggccggaaaagtagttccagaaccaattcaaactattctgggcctgtctctcgaatgttatccggaggagcctgactgcatgtccaaaggggcatattttctaccagagttgaagaacgcctcactgattgacgtcatggcaacaagtatgtaccttgggccggatgaattcaacgtcaccaatgcccagatgatcattggtggcgcctatgacaaggcaaaggtggacggtgacatgttcacgctggagatggtggatccattctccacactcaccggcgaacaaacgaactacgtgaacgtcactgcaatggaagttgtacttgacggcggcaaccgcacgtcacaaacctttggagataagggtgttggtgtccccatcttgctcgacacgggcattgcaacctggtacgtgactgataccattttcggcgccgtctcctacggattgggtattaccgccttccaacctggaaaacaggtgacctctgttgactgcaagtaccgggaccccaacaatgccaagggctacatctctgtcgaattcggcgctagtggcaagattgacgttccgctgcacgaaattatctctctgtttgctaatagcacgtgtggcgtctacatggagcctcgctcggaaaccgatattggcgtactcgcagacccctttattcgtgcaatttacgcaatcttcgaccagacccacaggaccatcacaatgggcaaagcaaaatacacaactgagcagaacattgtgcccttccccgagggaggtttcacagtgggctccaaggtcagctcttag

SEQ ID NO: 249 - protein, 524 aa, Cochliobolus heterostrophus strain C4 (ATCC 48331)
  DOMAIN (104)...(500): Eukaryotic aspartyl protease
MAPIKLVGWKWRTGWPGIIRLAGWERKELVLTRCSVHFGIHETRIRYIVLQKPGPPQTHKPAYALEITVDRPHPTLRSALGRSAERQASGTHIKTCHGSVFPCLARICAILLSHSTIMPDSKMVSRALLAALALPAVSAELPPGAIAVPLIRDAELDAYYAEFQVGTPPQKEYLKVDTGSPRYSFLNPRNQECVSDPASCTTFGTFDNLTSSTCRYEGPGFYDELYALGFGDYLSDTLVLGGVTMPNMYFGYTSNYTAGKVVPEPIQTILGLSLECYPEEPDCMSKGAYFLPELKNASLIDVMATSMYLGPDEFNVTNAQMIIGGAYDKAKVDGDMFTLEMVDPFSTLTGEQTNYVNVTAMEVVLDGGNRTSQTFGDKGVGVPILLDTGIATWYVTDTIFGAVSYGLGITAFQPGKQVTSVDCKYRDPNNAKGYISVEFGASGKIDVPLHEIISLFANSTCGVYMEPRSETDIGVLADPFIRAIYAIFDQTHRTITMGKAKYTTEQNIVPFPEGGFTVGSKVSS

SEQ ID NO: 250 - DNA, 6066 bp, Cochliobolus heterostrophus strain C4 (ATCC 48331)
  CDS (3361)...(3553): Exon
  CDS (3608)...(3767): Exon
  CDS (3821)...(5108): Exon
taagtggtctctctaggctgcaacctcgtcacctgacccatctgtttccaggggggatcagactggatggctgggaagccaaagtggtaggtgaacttgtactttttgaggttggcgaagatgattgctgtaaaagaggagaggagtgaggggcattcgtagatggagccgtcgtgtatagcatcccatatctaggcatgatcagtagacaaataggcggctgagagtggacatgcatactgtctgggcagaacgttcaagtatggcagcgcgatcaaggctcttgtagtcctcgatggtgttgcagttcttgatgatgccttcagcgcggcaaaaggtcgggggcgtgctaacggggtgttagacgtgtagtaagcatcggcatgatatggcgtactcatccgatgtcagcgcattgggatggatctggatgcgcatggagcgcgaggagtgctcagtagggcgaacctcgtacaggcccagcactttgcgcgccgagtcgtcgagcttgtcatggttgattttgatatgggcgagggcggcgtagaactggacatcgacgtcgctcatccaaggcgcgaacttgagggtcgccatggtgggtgatagtggggctggcggggtgttggaggcgtcgggagagggcgatgggtagagagcagagagttcagtgtctatggcgtgtaggtcatatgggtgtatgtatggaggtacgtatgtacatagatggccagaagcaagacacagggcgaggcacgtgaagctgtcaagagagcgtgatatgtgctgctgagggcttcaggcggccatacatgtgcatgtcatgcccccgccaggccgtcacataggcggggcagcgctgaggcgcgttcctgcagccgcacacgcgcgctaacccccgtcttcagcgacaccgacacgtcgagcttcttgtcccccgcctttctcccttcacaacaatcatctatcactatgcttattggagtgtgtggaggcaagaaactcgcaagactcgctggccagttgctgacaaggcagcaggaatctgcgcgggcaagtccgagatagcttcgtgcctcatcgacgagtacaacttcacccgcctacgcctggcaggcccttctgcaaagcccgacaatgaccactctgcctcggcacagggtttcgtagatcctcagtataccttccagcatgtcgattcgctgctcgactttgtcacgctgagatggagggaacgatgggtcacgaccgacatttgggatgcctctgttgtcgatgcccttttgaaaaggcctttctttttgcttgtcagtgtcgatgcccctgtcagagtgcggtggcagcggtaccatgatcgctgcacggcaagcaacactgttccaccgtccatcctcgaatttgtcgcccagaacgatgaccatcagtttgctccaaacacaggcctgagtggattgtcctaccgagcacagcttaacctcctcaacagcaccacttcgatagactctctgcgcgctgccatacgctccctcgatcttaccgacgaagcccgcctgcgtccaagttgggaccaatatttcatgcaactggccgacctggcagcgctgcggagcaattgcatgaagaggagagttggttgctgcatagttcgggagaagcgtgtgataagcactggatacaatggcacgccacgcggtatgaccaactgcaacgagggcggatgtatgtgtgcaaccgacggacgttttggctttatgtgctgaccacgtccaggccctcgttgtaacaatgctgcaaagggaggctctggcctatccacctgcctctgtcttcatgctgaagaaaatgctctactcgaagcaggccgtgaccgtattggcggcagcgctatcctctactgcaacacatgtccctgtctgacatgtagcgtcaagatcacccaggtcggtataactgaggtcgtatacaatcaaggctacttggtggatgaccagacggccaagatattcgccgagagtggggtcaagctgcggcaattttctccgcccactggtggcttggttgacttgggaatcggatttgctggcaacagataagaaggtgtatcttcggatggacactagttagttatgactgcatctggtggactatgacgccatagcgagcctgtgatgttactagaggctggattgtcgacattagaatgtaggcgtgacgaggtcgcctgatagttgatggatggcatatctgtgctggacgtttcttggaagtatcacaatatcacagaggtgctagagaaggtcgttctatacggcataaagagattctgttatttccgaagggggggaagttttgaaaagatggcattgtgtttatcagggccgaacagcgactgagggcgggctgtgcactagtggcgcggaagcctacggcagccgttgcgccacatgtcacctgccatatgcgtggcgaccacacgggaagcttgccgcacctgccgtcatcttgtcattgcaccgttccacttactttggtagacactggttgcgccagaaatggtcagatcggtagcattgctgtagtccttcaagttgagtacaaattgactttgaaggctatcattcgtttccccggtaagtatgcagtgcttaccgccgccggcccttttgttccctactactgacccaacgagccaggattttaaccatccgcccgggcctccatgtcaaagcaaaacatgtttctacgggagtcaacaaaccttatttgttaaaatgatgcgcagatccacaccctgccccgccatctcgtatgtcccgaccgcagtcgtttagcaaacagatttacgaacaggactgcgcacgccttcttgttaggctatctggctattctagcaggtggggaccatcatgtcgcacaccggtgaacaagcttgaccaagcatcgacaagcattccttgcgaggctgatcgctccacttagtctgggcaccaggaactgtcaccgcgcaccttgcatggatatcctccaatcacaacttccacctctacggctccatcgtacgattcaggaaggtccacaagctctgcgttattggcaactgcatcgtgctagtacttatgtgattgcttatccactgtcaacctctgcccgatggcacggcctacgcggcctgcacggctgacatactagacggtttatcacgcgtggatttccatgtttaatgtatctccttctcttctgggataagtgccagggtgcttgtccagccgtcatgtcttgtactaagtgctcaaataccgctgtttgcctcgattcacagtctcctgctttggtagcgaccgctcgtctgtcaatctcaacatgaagctcctttcggtcttcggttcatttctctgtgcttcagcagctctcgctgcaaatgcccctcgctttctcagacctaacagagtccatcgccccaatccagtcattgagaagcgtgtccctggacaggactttcagaacccagagatcaacaagagagctcataccttcctcaacgcaaagacccaacgtgagtaccgatcttgttgtcttatgtatacagacatatactcattgcctttagcctttgctgtcgatggcaagaatgtccccttggccaatttcgacttaggtgagagttatgctggcttactacccatctccaacgacaaaaacgaaacgcgcaagctttttttctggttctttccatctacccaggccaagacaccggaggaaatcgtcatctggcaagtcaattcaagcttttctcccatgtcccagtctaacatttgcgtaggcttaatggtggccctggatgtagttcactcagcggtttgctccaagagaacggcccgttcttgtggcaagacggcactcttgccccaactcagaacccttattcatggcacaacctcaccaacatgctttgggtcgaacagcctgttggtgtcggctattcggaaggcgagcccgatatcagcaacgaatacgaactcagtgaccaattccgcggcttttacaagaactttgtcgatctctttggtgtctggaactggaagacttatgttaccggagagtcatatgctggcttttacgttccttacattgctgacagcttcatccgtgccaatgacaagaaatacttcaatcttggtggcatcgcaatcaacgaccccatcatcggtactgatactgtccaacagcagatcgtcatccggccctacgtcgaattctggcaaaatgtcttctacttgaaccagactttcttagaaagagcccgaaagcgcgacctggaatgcggttacacccagtattatgaaaaatacttcaaattccctccgccaaaggggcccttcccaaatctccctgacccattcgacagtacgggtgatgtcccaatttgcgaccagttcgataactacgcccaagccattgccgaggtaaatccttgctttgacgtctaccacatcaccgaaacctgtccgttcaagtcgacgccgctcggtggaaccaacccaggagattatgtcgcaccaggcacggaagtctattttgaccgcgcagatgtcaagaaggctcttcatgccagtcctaacagcacatggatgttgtgcacagataagaacgtcttcgccggtgccggcgtaaacggctcagacacgtctgtcccacccgccaacagcggcgtcctccaaaacgttattgaaaaaacaaacaacgtcatgatcggctctggagacctcgacatacttctcagcacaaacggcaccctcctcgcccttcaaaacatgacttggaacggcgcacaaggtctaaccagatacccctcccaaaacctctacgtgccttaccaccccgaattcaacggcggtgcactagctggcgctggataccagggcttatggaccaaagaacgcggtctgaccttctacactgcgcgtcttgcaggtcatgagttgccaggttacacgcctggcgtcggataccgcatgttggagattctgctcggtcgcatctccgattttagcagcacccgcgatttcaccacccaaacaggtaattttactggtaccaccgatctctattagtagacgagtaggatacctagcattacctgtttttcgccgatgattgagattttttgttgtaaatataaaacttcttagttgcaaattatcgcgttgttggcgccggatatgttcgggtatatccacttttgctaaacttacactatgacacttgcattcttgacaaccttgctatgatccctacccgttgtctaccttttcagtaatcacccaatttggcgatgtgccactaggcccagagtagccttacccctcttttgccttttcgcctctccatccttggcaaccccgctcaactagagaggaaaggatccgtaccaaaagcccttcttccgcgcctcccccccctccctccactccctgcaatcagaaaatgtgaacataatctaatcatctggagatacaaacatcgctctgatcacccagatcccggctcgctatgtacggcagtatagtgaatactgcgttgattatcacttttacgtgaatccgttttggaaaagcaacctaccaagcatcttaaaattgcctatttgagtgattgcttctaggatacaggaatgtagatgacaaagcgagagcatgcttagttattcattactagaaccacgcattccttcctactacatcccgccagcttcgccctctcactccttttttcatccaaactgaaatcttctgcgcagaaagctattagaggagcgccttgaatctttctcactgtagtttatcgatgaagaatggtttggatgtccttttgtaaccaacgttgatgtctgaccccacgcatcgctcatatcgcgactccagttcacattcagagatggcggtatcgccacgcataatgaagcacaatcatggtgatagttttctgcattttcgactttatcaatatcgcttcgtatcaggccctagaacctggggtatgcgagatggtcataacatagacgaagct

SEQ ID NO: 251 - protein, 64 aa, Cochliobolus heterostrophus strain C4 (ATCC 48331)
MKLLSVFGSFLCASAALAANAPRFLRPNRVHRPNPVIEKRVPGQDFQNPEINKRAHTFLNAKTQ

SEQ ID NO: 252 - protein, 54 aa, Cochliobolus heterostrophus strain C4 (ATCC 48331)
PFAVDGKNVPLANFDLGESYAGLLPISNDKNETRKLFFWFFPSTQAKTPEEIVM

SEQ ID NO: 253 - protein, 429 aa, Cochliobolus heterostrophus strain C4 (ATCC 48331)
LNGGPGCSSLSGLLQENGPFLWQDGTLAPTQNPYSWHNLTNMLWVEQPVGVGYSEGEPDISNEYELSDQFRGFYKNFVDLFGVWNWKTYVTGESYAGFYVPYIADSFIRANDKKYFNLGGIAINDPIIGTDTVQQQIVIRPYVEFWQNVFYLNQTFLERARKRDLECGYTQYYEKYFKFPPPKGPFPNLPDPFDSTGDVPICDQFDNYAQAIAEVNPCFDVYHITETCPFKSTPLGGTNPGDYVAPGTEVYFDRADVKKALHASPNSTWMLCTDKNVFAGAGVNGSDTSVPPANSGVLQNVIEKTNNVMIGSGDLDILLSTNGTLLALQNMTWNGAQGLTRYPSQNLYVPYHPEFNGGALAGAGYQGLWTKERGLTFYTARLAGHELPGYTPGVGYRMLEILLGRISDFSSTRDFTTQTGNFTGTTDLY

SEQ ID NO: 254 - DNA, 1644 bp, Cochliobolus heterostrophus strain C4 (ATCC 48331)
  CDS (1)...(1644)
atgaagctcctttcggtcttcggttcatttctctgtgcttcagcagctctcgctgcaaatgcccctcgctttctcagacctaacagagtccatcgccccaatccagtcattgagaagcgtgtccctggacaggactttcagaacccagagatcaacaagagagctcataccttcctcaacgcaaagacccaaccctttgctgtcgatggcaagaatgtccccttggccaatttcgacttaggtgagagttatgctggcttactacccatctccaacgacaaaaacgaaacgcgcaagctttttttctggttctttccatctacccaggccaagacaccggaggaaatcgtcatgcttaatggtggccctggatgtagttcactcagcggtttgctccaagagaacggcccgttcttgtggcaagacggcactcttgccccaactcagaacccttattcatggcacaacctcaccaacatgctttgggtcgaacagcctgttggtgtcggctattcggaaggcgagcccgatatcagcaacgaatacgaactcagtgaccaattccgcggcttttacaagaactttgtcgatctctttggtgtctggaactggaagacttatgttaccggagagtcatatgctggcttttacgttccttacattgctgacagcttcatccgtgccaatgacaagaaatacttcaatcttggtggcatcgcaatcaacgaccccatcatcggtactgatactgtccaacagcagatcgtcatccggccctacgtcgaattctggcaaaatgtcttctacttgaaccagactttcttagaaagagcccgaaagcgcgacctggaatgcggttacacccagtattatgaaaaatacttcaaattccctccgccaaaggggcccttcccaaatctccctgacccattcgacagtacgggtgatgtcccaatttgcgaccagttcgataactacgcccaagccattgccgaggtaaatccttgctttgacgtctaccacatcaccgaaacctgtccgttcaagtcgacgccgctcggtggaaccaacccaggagattatgtcgcaccaggcacggaagtctattttgaccgcgcagatgtcaagaaggctcttcatgccagtcctaacagcacatggatgttgtgcacagataagaacgtcttcgccggtgccggcgtaaacggctcagacacgtctgtcccacccgccaacagcggcgtcctccaaaacgttattgaaaaaacaaacaacgtcatgatcggctctggagacctcgacatacttctcagcacaaacggcaccctcctcgcccttcaaaacatgacttggaacggcgcacaaggtctaaccagatacccctcccaaaacctctacgtgccttaccaccccgaattcaacggcggtgcactagctggcgctggataccagggcttatggaccaaagaacgcggtctgaccttctacactgcgcgtcttgcaggtcatgagttgccaggttacacgcctggcgtcggataccgcatgttggagattctgctcggtcgcatctccgattttagcagcacccgcgatttcaccacccaaacaggtaattttactggtaccaccgatctctattag

SEQ ID NO: 255 - protein, 547 aa, Cochliobolus heterostrophus strain C4 (ATCC 48331)
  SIGNAL (1)...(18)
  DOMAIN (74)...(522): Serine carboxypeptidase
MKLLSVFGSFLCASAALAANAPRFLRPNRVHRPNPVIEKRVPGQDFQNPEINKRAHTFLNAKTQPFAVDGKNVPLANFDLGESYAGLLPISNDKNETRKLFFWFFPSTQAKTPEEIVMLNGGPGCSSLSGLLQENGPFLWQDGTLAPTQNPYSWHNLTNMLWVEQPVGVGYSEGEPDISNEYELSDQFRGFYKNFVDLFGVWNWKTYVTGESYAGFYVPYIADSFIRANDKKYFNLGGIAINDPIIGTDTVQQQIVIRPYVEFWQNVFYLNQTFLERARKRDLECGYTQYYEKYFKFPPPKGPFPNLPDPFDSTGDVPICDQFDNYAQAIAEVNPCFDVYHITETCPFKSTPLGGTNPGDYVAPGTEVYFDRADVKKALHASPNSTWMLCTDKNVFAGAGVNGSDTSVPPANSGVLQNVIEKTNNVMIGSGDLDILLSTNGTLLALQNMTWNGAQGLTRYPSQNLYVPYHPEFNGGALAGAGYQGLWTKERGLTFYTARLAGHELPGYTPGVGYRMLEILLGRISDFSSTRDFTTQTGNFTGTTDLY

What is claimed is:

1. An isolated, synthetic, or recombinant polypeptide having at least 95% sequence identity to SEQ ID NO:42,
   wherein the sequence identities are determined by analysis with a sequence comparison algorithm or by a visual inspection, and
   wherein the polypeptide has a protease activity.

2. An array of immobilized polypeptides comprising the polypeptide of claim 1;
   wherein the polypeptides are immobilized on a cell, a metal, a resin, a polymer, a ceramic, a glass, a microelectrode, a graphitic particle, a bead, a gel, a plate, or a capillary tube.

3. A detergent composition comprising the polypeptide of claim 1.

4. A feed or a food comprising the polypeptide of claim 1.

5. The isolated, synthetic or recombinant polypeptide of claim 1, wherein the polypeptide has at least 97% sequence identity to SEQ ID NO:42.

6. The isolated, synthetic or recombinant polypeptide of claim 1, wherein the polypeptide has at least 98% sequence identity to SEQ ID NO:42.

7. The isolated, synthetic or recombinant polypeptide of claim 1, wherein the polypeptide has the sequence of SEQ ID NO:42.

8. The isolated, synthetic or recombinant polypeptide of claim 1, wherein the protease activity further comprises catalyzing hydrolysis of peptide bonds; an endoprotease activity or an exoprotease activity; a proteinase activity or a peptidase activity; a carboxypeptidase activity; an aminopeptidase activity; a serine protease activity; a metalloprotease activity, a matrix metalloprotease activity or a collagenase activity; a cysteine protease activity; an aspartic protease activity; a chymotrypsin, a trypsin, an elastase, a kallikrein or a subtilisin activity; or a dipeptidylpeptidase activity.

9. The isolated, synthetic or recombinant polypeptide of claim 1, wherein the protease activity is thermostable or thermotolerant.

10. The isolated, synthetic or recombinant polypeptide of claim 1, wherein the polypeptide comprises at least one glycosylation site.

11. The isolated, synthetic or recombinant polypeptide of claim 1, wherein the polypeptide retains a protease activity under conditions comprising a range from pH 4.0 to pH 10.5.

* * * * *

UNITED STATES PATENT AND TRADEMARK OFFICE
CERTIFICATE OF CORRECTION

PATENT NO. : 7,642,079 B2
APPLICATION NO. : 10/530643
DATED : January 5, 2010
INVENTOR(S) : Cayouette et al.

Page 1 of 1

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 669 days.

Signed and Sealed this

Sixteenth Day of November, 2010

David J. Kappos
*Director of the United States Patent and Trademark Office*